US008003772B2

(12) United States Patent
Weaver et al.

(10) Patent No.: US 8,003,772 B2
(45) Date of Patent: Aug. 23, 2011

(54) CHIMERIC PUFA POLYKETIDE SYNTHASE SYSTEMS AND USES THEREOF

(75) Inventors: Craig A. Weaver, Boulder, CO (US);
Ross Zirkle, Longmont, CO (US);
Daniel H. Doherty, Boulder, CO (US);
James G. Metz, Longmont, CO (US)

(73) Assignee: Martek Biosciences Corporation, Columbia, MD (US)

( * ) Notice: Subject to any disclaimer, the term of this patent is extended or adjusted under 35 U.S.C. 154(b) by 0 days.

(21) Appl. No.: 11/749,686

(22) Filed: May 16, 2007

(65) Prior Publication Data

US 2008/0022422 A1 Jan. 24, 2008

Related U.S. Application Data

(63) Continuation-in-part of application No. 11/689,438, filed on Mar. 21, 2007, now abandoned, which is a continuation of application No. 10/965,017, filed on Oct. 13, 2004, now Pat. No. 7,217,856, which is a continuation-in-part of application No. 10/810,352, filed on Mar. 26, 2004, now Pat. No. 7,211,418, and a continuation-in-part of application No. 09/231,899, filed on Jan. 14, 1999, now Pat. No. 6,566,583, application No. 11/749,686, which is a continuation-in-part of application No. 11/668,333, filed on Jan. 29, 2007, now abandoned, which is a continuation of application No. 11/452,096, filed on Jun. 12, 2006, now abandoned, application No. 11/749,686, which is a continuation-in-part of application No. 11/452,138, filed on Jun. 12, 2006, now Pat. No. 7,271,315, and a continuation-in-part of application No. 10/124,800, filed on Apr. 16, 2002, now Pat. No. 7,247,461.

(60) Provisional application No. 60/457,979, filed on Mar. 26, 2003, provisional application No. 60/284,066, filed on Apr. 16, 2001, provisional application No. 60/298,796, filed on Jun. 15, 2001, provisional application No. 60/323,269, filed on Sep. 18, 2001, provisional application No. 60/784,616, filed on Mar. 21, 2006, provisional application No. 60/689,167, filed on Jun. 10, 2005.

(51) Int. Cl.
*C07H 21/04* (2006.01)
*C12P 7/64* (2006.01)

(52) U.S. Cl. .................... 536/23.2; 435/134; 435/440

(58) Field of Classification Search .................... None
See application file for complete search history.

(56) References Cited

U.S. PATENT DOCUMENTS

| | | |
|---|---|---|
| 5,130,242 A | 7/1992 | Barclay et al. |
| 5,246,841 A | 9/1993 | Yazawa et al. |
| 5,310,242 A | 5/1994 | Golder |
| 5,639,790 A | 6/1997 | Voelker et al. |
| 5,672,491 A | 9/1997 | Khosla et al. |
| 5,683,898 A | 11/1997 | Yazawa et al. |
| 5,798,259 A | 8/1998 | Yazawa et al. |
| 5,908,622 A | 6/1999 | Barclay |
| 6,033,883 A | 3/2000 | Barr et al. |
| 6,140,486 A | 10/2000 | Facciotti et al. |
| 6,503,706 B1 | 1/2003 | Abken et al. |
| 6,566,583 B1 | 5/2003 | Facciotti et al. |
| 6,677,145 B2 | 1/2004 | Mukerji et al. |
| 7,001,772 B2 | 2/2006 | Roessler et al. |
| 7,087,432 B2 | 8/2006 | Qiu et al. |
| 7,125,672 B2 | 10/2006 | Picataggio et al. |
| 7,208,590 B2 | 4/2007 | Mukerji et al. |
| 7,211,418 B2 | 5/2007 | Metz et al |
| 7,214,853 B2 | 5/2007 | Facciotti et al. |
| 7,217,856 B2 | 5/2007 | Weaver et al. |
| 7,247,461 B2 | 7/2007 | Metz et al. |
| 7,256,022 B2 | 8/2007 | Metz et al. |
| 7,256,023 B2 | 8/2007 | Metz et al. |
| 7,259,295 B2 | 8/2007 | Metz et al. |
| 7,271,315 B2 | 9/2007 | Metz et al. |
| 2004/0005672 A1 | 1/2004 | Santi et al. |
| 2004/0010817 A1 | 1/2004 | Shockey et al. |
| 2004/0139498 A1 | 7/2004 | Jaworski et al. |
| 2004/0172682 A1 | 9/2004 | Kinney et al. |
| 2005/0089865 A1 | 4/2005 | Napier et al. |
| 2005/0164192 A1 | 7/2005 | Graham et al. |
| 2007/0244192 A1 | 10/2007 | Metz |
| 2007/0245431 A1 | 10/2007 | Metz et al. |
| 2007/0256146 A1 | 11/2007 | Metz et al. |

(Continued)

FOREIGN PATENT DOCUMENTS

| | | |
|---|---|---|
| CA | 2520795 | 10/2004 |
| EP | 0594868 | 5/1994 |
| EP | 0823475 | 2/1998 |
| WO | WO 93/23545 | 11/1993 |
| WO | WO 96/21735 | 7/1996 |
| WO | WO 98/46764 | 10/1998 |
| WO | WO 98/55625 | 12/1998 |
| WO | WO 00/42195 | 7/2000 |
| WO | WO 02/083870 | 10/2002 |
| WO | WO 2004/087879 | 10/2004 |
| WO | WO 2006/008099 | 1/2006 |
| WO | WO 2006/034228 | 3/2006 |

OTHER PUBLICATIONS

Bedford et al, A functional chimeric modular polyketide synthase generated via domain replacement. Chemistry & Biology 3: 827-831, Oct. 1996.*

(Continued)

*Primary Examiner* — Elizabeth McElwain
(74) *Attorney, Agent, or Firm* — Sterne, Kessler, Goldstein & Fox P.L.L.C.

(57) ABSTRACT

Disclosed are chimeric polyunsaturated fatty acid (PUFA) polyketide synthase (PKS) proteins and chimeric PUFA PKS systems, including chimeric PUFA PKS proteins and systems derived from *Schizochytrium* and *Thraustochytrium*. Disclosed are nucleic acids and proteins encoding such chimeric PUFA PKS proteins and systems, genetically modified organisms comprising such chimeric PUFA PKS proteins and systems, and methods of making and using such chimeric PUFA PKS proteins and systems.

19 Claims, 11 Drawing Sheets

U.S. PATENT DOCUMENTS

| | | |
|---|---|---|
| 2007/0266455 A1 | 11/2007 | Weaver et al. |
| 2007/0270494 A1 | 11/2007 | Metz et al. |
| 2008/0026434 A1 | 1/2008 | Weaver et al. |
| 2008/0026435 A1 | 1/2008 | Weaver et al. |
| 2008/0026436 A1 | 1/2008 | Weaver et al. |
| 2008/0026437 A1 | 1/2008 | Weaver et al. |
| 2008/0026438 A1 | 1/2008 | Metz et al. |
| 2008/0026439 A1 | 1/2008 | Metz et al. |
| 2008/0026440 A1 | 1/2008 | Metz et al. |
| 2008/0032296 A1 | 2/2008 | Weaver et al. |
| 2008/0032338 A1 | 2/2008 | Weaver et al. |
| 2008/0032351 A1 | 2/2008 | Metz et al. |
| 2008/0032367 A1 | 2/2008 | Weaver et al. |
| 2008/0032368 A1 | 2/2008 | Weaver et al. |
| 2008/0032369 A1 | 2/2008 | Weaver et al. |
| 2008/0038378 A1 | 2/2008 | Metz et al. |
| 2008/0038379 A1 | 2/2008 | Metz et al. |
| 2008/0038790 A1 | 2/2008 | Metz et al. |
| 2008/0038791 A1 | 2/2008 | Metz et al. |
| 2008/0038792 A1 | 2/2008 | Metz et al. |
| 2008/0038793 A1 | 2/2008 | Metz et al. |
| 2008/0038794 A1 | 2/2008 | Metz et al. |
| 2008/0038795 A1 | 2/2008 | Metz et al. |
| 2008/0038796 A1 | 2/2008 | Metz et al. |
| 2008/0038797 A1 | 2/2008 | Metz et al. |
| 2008/0038798 A1 | 2/2008 | Weaver et al. |
| 2008/0038799 A1 | 2/2008 | Weaver et al. |
| 2008/0040822 A1 | 2/2008 | Metz et al. |
| 2008/0044867 A1 | 2/2008 | Metz et al. |
| 2008/0044868 A1 | 2/2008 | Metz et al. |
| 2008/0044869 A1 | 2/2008 | Metz et al. |
| 2008/0044870 A1 | 2/2008 | Metz et al. |
| 2008/0044871 A1 | 2/2008 | Metz et al. |
| 2008/0044872 A1 | 2/2008 | Metz et al. |
| 2008/0044873 A1 | 2/2008 | Metz et al. |
| 2008/0044874 A1 | 2/2008 | Weaver et al. |
| 2008/0050790 A1 | 2/2008 | Metz et al. |
| 2008/0050791 A1 | 2/2008 | Weaver et al. |
| 2008/0148433 A1 | 6/2008 | Metz et al. |

OTHER PUBLICATIONS

U.S. Appl. No. 11/674,574, filed Feb. 13, 2007, Facciotti et al.
U.S. Appl. No. 11/777,277, filed Jul. 12, 2007, Metz et al.
U.S. Appl. No. 11/778,594, filed Jul. 16, 2007, Metz et al.
U.S. Appl. No. 11/781,861, filed Jul. 23, 2007, Weaver et al.
U.S. Appl. No. 11/781,882, filed Jul. 23, 2007, Weaver et al.
Abbadi et al., "Transgenic oilseeds as sustainable source of nutritionally relevant C20 and C22 polyunsaturated fatty acids?" Eur. J. Lipid Sci. Technol., 103:106-113 (2001).
Allen E.A. et al. 2002 "Structure and regulation of the omega-3 polyunsaturated fatty acid synthase genes from the deep-sea bacterium *Photobacterium profundum* strain SS9" Microbiology vol. 148 pp. 1903-1913.
Allen et al., "Monounsaturated but not polyunsaturated fatty acids are required for growth of the deep-sea bacterium *Photobacterium profundum* SS9 at high pressure and low temperature." Appl. Envir. Microbiol., 65(4):1710-1720 (1999).
Bateman et al., "The Pfam protein families database" Nucl. Acids Res., 30(1):276-280 (2002).
Bentley et al., "Constructing polyketides: from collie to combinatorial biosynthesis." Annu. Rev. Microbiol., 53:411-46 (1999).
Bisang et al., "A chain initiation factor common to both modular and aromatic polyketide synthases" Nature, 401:502-505 (1999).
Bork, Go hunting in sequence databases but watch out for the traps, 1996, TIG, vol. 12 No. 10, pp. 425-427.
Brenner, "Errors in genome annotation" 1999, TIG, vol. 15 No. 4, pp. 132-133.
Broun et al, "Catalytic Plasticity of Fatty Acid Modification Enzymes Underlying Chemical Diversity of Plant Lipids", 1998, Science vol. 282, pp. 1315-1317.
Cane et al., "Harnessing the Biosynthetic Code: Combinations, Permutations, and Mutations." Science 1998, vol. 282, pp. 63-68.
Chuck et al., "Molecular recognition of diketide substrates by a beta-ketoacyl-acyl carrier protein synthase domain within a bimodular polyketide synthase", Chem and Bio, Current Bio, (London), GB,, vol. 4, No. 10, 1997, pp. 757-766, XP000884721.
Creelman et al., "Biosynthesis and Action of Jasmonates in Plants." Annu. Rev. Plan Physiol. Plant Mol. Biol., 48:355-81 (1997).
Database Geneseq 'Online! Dec. 11, 2000, "S. aggregatum PKS cluster ORF6 homolog DNA." XP002368912, retrieved from EBI accession No. GSN:AAA71567Database accession No. AAA71567—& Database Geneseq 'Online! Dec. 11, 2000, "S. aggregatum PKS cluster ORF6 homolog protein." XP002368914 retrieved from EBI accession No. GSP:AAB10482 Database accession No. AAB10482 & WO 00/42195 A (Calgene, LLC) Jul. 20, 2000.
Delong & Yayanos, "Biochemical Function and Ecological Significance of Novel Bacterial Lipids in Deep-Sea Procaryotes." Appl. Environ. Microbiol, 51(4):730-737 (1986).
Doerks, "Protein annotation: detective work for function prediction", 1998, TIG vol. 14 No. 6, pp. 248-250.
Facciotti et al., "Cloning and Characterization of Polyunsaturated Fatty Acids (PUFA) Genes from Marine Bacteria" in Abstracts of the international symposium on progress and prospect of marine biotechnology (China Ocean Press) 1998, Abstract (p. 14).
GenBank Accession No. AF4091 00, (Allen et al.) 2002.
GenBank Accession No. U09865. Alcaligenes eutrophus pyruvate dehydrogenase (pdhA), dihydrolipoamide acetyltransferase (pdhB), dihydrolipoamide dehydrogenase (pdhL), and ORF3 genes, complete cds (1994).
Harlow et al. Antibodies: A Laboratory Manual (1988) Cold Spring Harbor Laboratory Press, p. 76.
Heath and Rock (1996) "Roles of the FabA and FabZ beta-hydroxyacyl-acyl carrier protein dehydratases in *Escherichia coli* fatty acid biosynthesis." The Journal of Biological Chemistry, vol. 271, No. 41, pp. 27795-27801.
Hopwood & Sherman, (1990) "Molecular genetics of polyketides and its comparison to fatty acid biosynthesis." Annu. Rev. Genet. 24:37-66.
Hutchinson, "Polyketide synthase gene manipulation: a structure-function approach in engineering novel antibiotics." Annu. Rev. Microbiol., 49:201-238 (1995).
Jez et al., "Structural control of polyketide formation in plant-specific polyketide synthases", Chem and Bio (London), vol. 7, No. 12, Dec. 2000, pp. 919-930, XP002338564.
Jostensen & Landfald, (1997) "High prevalence of polyunsaturated-fatty-acid producing bacteria in arctic invertebrates" FEMS Microbiology Letters, 151:95-101.
Kaulmann et al. "Biosynthesis of Polyunsaturated Fatty Acids by Polyketide Synthases", Angew. Chem. Int. Ed. 2002, 41, No. 11, pp. 1866-1869.
Katz & Donadio, "Polyketide synthesis: prospects for hybrid antibiotics." Annu. Rev. Microbiol., 47:875-912 (1993).
Kealey et al., "Production of a polyketide natural product in nonpolyketide-producing prokaryotic and eukaryotic hosts", Proceedings of the National Academy of Sciences of the United States of America, vol. 95, No. 2, Jan. 20, 1998, pp. 505-509, XP002338563.
Keating et al., "Initiation, elongation, and termination strategies in polyketide and polypeptide antibiotic biosynthesis." Curr. Opin. Chem. Biol., 3:598-606 (1999).
Khosla et al., "Tolerance and Specificity of Polyketide Synthases", Annu. Rev. Biochem. 1999. 68:219-253.
Kyle et al., "Long-chain Omega-3 Polyunsaturated Fatty Acids: Prospects for Introduction into Horticultural Food Plants," HortScience. vol. 25, Dec. 1990 pp. 1523-1526.
Leadlay PF. "Combinatorial Approaches to Polyketides Biosynthesis" Current Opinion in Chemical Biology (1997) 1: 162-168.
Magnuson, "Regulation of fatty acid biosynthesis in *Escherichia coli*." Microbil. Rev., 57(3):522-542 (1993) Abstract.
Metz et al., "Production of polyunsaturated fatty acids by polyketide synthases in both prokaryotes and eukaryotes." Science, 293:290-293 (2001).
Nakahara et al. Production of docosahexaenoic and docosapentaenoic acids by *Schizochytrium* sp. isloated from Yap Islands. 1996 J. Am. Oil Chem. Soc. 1996, vol. 73, No. 11, pp. 1421-1426.

Nakahara, Toro, "Physiological activity of docosahexaenoic acid (DHA) and its production by microbial culture," Yukagaku (1995) 44(10) pp. 821-827.
Napier "Plumbing the depths of PUFA biosynthesis: a novel polyketide synthase-like pathway from marine organisms." Trends in Plant Science. Feb. 2002, vol. 7, No. 2, pp. 51-54.
Nasu et al., "Efficient Transformation of *Marchantia polymorpha* That is Haploid and Has Very Small Genome DNA," Journal of Fermentation and Bioengineering vol. 84, No. 6, 519-523 1997.
Nichols et al., "Developments with antarctic microorganisms: culture collections, bioactivity screening, taxonomy, PUFA production and cold-adapted enzymes" Curr. Opin. Biotechnol., 10:240-246 (1999).
Nicholson et al., "Design and utility of oligonucleotide gene probes for fungal polyketide synthases", Chem & Bio (London) vol. 8, No. 2, Feb. 2001, pp. 157-178, XP002338562.
Nogi et al., "*Photobacterium profundum* sp. nov., a new, moderately barophilic bacterial species isolated from a deep-sea sediment." Extremophiles, 2:1-7 (1998).
Oliynuk et al. "A hybrid modular polyketide synthase obtained by domain swapping." Chemistry & Biology (1996) 3: 833-839.
Orikasa et al. Characterization of the eicosapentaenoic acid biosynthesis gene cluster from *Shewanella sp.* strain SCRC-2738, Cellular and Molecular Biology (Noisy-le-grand), Jul. 2004, vol. 50, No. 5, pp. 625-630.
Parker-Barnes et al., "Identification and characterization of an enzyme involved in the elongation of n-6 and n-3 polyunsaturated fatty acids." PNAS, 97(15):8284-8289 (2000).
Qiu et al. Identification of a delta4 fatty acid desaturase from *Thraustochytrium sp.* involved in the biosynthesis. J. Biol. Chem. Aug. 24, 2001, vol. 276, No. 34, pp. 31561-31566.
Sánchez et al., "Cloning and characterization of a phosphopantetheinyl transferase from *Streptomyces verticillus* ATCC15003, the producer of the hybrid peptide-polyketide antitumor drug bleomycin." Chemistry & Biology, 8:725-738 (2001).
Satomi et al. *Shewanelia marinintesina* sp. nov., *Shewanella schlegeliana* sp. nov. And *Shewanelia sairae* sp. nov., novel eicosapentaenoic-acid-producing marine bacteria isolated from seeanimal intestines. Internat. J. Syst. Evol. Microbiol. 2003, vol. 53, pp. 491-499.
Shanklin et al., "Desaturation and Related Modifications of Fatty Acids1." Annu. Rev. Plant Physiol. Plant Mol. Biol., 49:611-41 (1998).
Singh et al. Microbial Production of Docosahexaenoic Acid (DHA, C22:6) Adv. Appl. Microbial, 1997. vol. 45, pp. 271-312.
Smith et al, The challenges of genome sequence annotation or "The devil is in the details", 1997, Nature Biotechnology vol. 15, pp. 1222-1223.
Somerville, Chris, "Future prospects for genetic modification of the composition of edible oils from higher plants," Am. J. Clin. Nutr. (1993) 58 pp. 270s-275s.
Takeyama et al. Expression of eicosapentaenoic acid synthesis gene clustter from *Shewanella* sp. In transgenic marine cyanobacterium. *Synechecoccus* sp. Microbiology. 1997, vol. 143, pp. 2725-2731.
UniProt Accession No. Q93CG6_PHOPR, (Allen et al.) 2002.
Van de Loo, "An oleate 12-hydroxylase from *Ricinus communis L.* is a fatty acyl desaturase homolog", 1995, Pro. Natl. Acad. Sci. vol. 92, pp. 6743-6747.
Wallis et al., "Polyunsaturated fatty acid synthesis: what will they think of next?", Tibs Trends in Bio Sciences, Elsevier Publ., Cambridge, EN, vol. 27, No. 9, Sep. 2002, pp. 467-473, XP004378766.
Watanabe et al., "Fatty acid synthesis of an eicosapentaenoic acidproducing bacterium: de novo synthesis, chain elongation, and desaturation systems." J. Biochem., 122:467-473 (1997).
Weete et al. Lipids and Ultrastructure of *Thrauchytrium* sp. ATCC26185. 1997, Am Oil Chem. Soc. vol. 32, No. 8, pp. 839-845.
Wiesmann et al. "The molecular basis of Celmer's rules: the stereochemistry of the condensation step in chain extension on the erythromycin polyketide synthase." Biochemistry (1997) 36: 13849-13855.
Wiesmann et al. "Origin of starter units for erythromycin biosynthesis." Biochemistry (1998) 37: 11012-11017.
Wiesmann et al. "Polyketide synthesis in vitro on a modular polyketide synthase." Chemistry & Biology (Sep. 1995) 2: 583-589.
Yalpani et al., "Production of 6-methylsalicylic acid by expression of a fungal polyketide synthase activates disease resistance in tobacco." The Plant Cell, 13:1401-1409 (2001).
Yazawa, (1996) "Production of eicosapentaenoic acid from marine bacteria." Lipids 31 (supplement): S-297-S-300.
Yokochi et al. Optimization of docosahexaenoic acid production. App. Microbiol. Biotechnol. 1998, vol. 49, pp. 72-76.
International Search Report for International (PCT) Patent Application No. PCT/US02/12254, mailed Nov. 15, 2002.
International Preliminary Examination Report for International (PCT) Patent Application No. PCT/US02/12254, mailed Oct. 16, 2006.
International Search Report for International (PCT) Patent Application No. PCT/US00/00956, mailed Jul. 6, 2000.
Written Opinion for International (PCT) Patent Application No. PCT/US00/00956, mailed Dec. 19, 2000.
International Preliminary Examination Report for International (PCT) Patent Application No. PCT/US00/00956, mailed Apr. 19, 2001.
International Search Report for International (PCT) Patent Application No. PCT/US04/09323, mailed Apr. 4, 2007.
Written Opinion for International (PCT) Patent Application No. PCT/US04/09323, mailed Apr. 4, 2007.
International Preliminary Report on Patentability for International (PCT) Patent Application No. PCT/US04/09323, mailed May 9, 2007.
International Search Report for International (PCT) Patent Application No. PCT/US05/36998, mailed Mar. 22, 2007.
Written Opinion for International (PCT) Patent Application No. PCT/US05/36998, mailed Mar. 22, 2007.
International Search Report for International (PCT) Patent Application No. PCT/US08/63835, mailed Nov. 3, 2008.
Written Opinion for International (PCT) Patent Application No. PCT/US08/63835, mailed Nov. 3, 2008.
International Search Report for International (PCT) Patent Application No. PCT/US06/22893, mailed Feb. 29, 2008.
Written Opinion for International (PCT) Patent Application No. PCT/US06/22893, mailed Feb. 29, 2008.
International Search Report for International (PCT) Patent Application No. PCT/US07/64105, mailed Nov. 23, 2007.
Written Opinion for International (PCT) Patent Application No. PCT/US07/64105, mailed Nov. 23, 2007.
International Preliminary Report on Patentabililty for International (PCT) Patent Application No. PCT/US07/64105, mailed Sep. 25, 2008.
International Search Report for International (PCT) Patent Application No. PCT/US07/64104, mailed Dec. 5, 2008.
Written Opinion for International (PCT) Patent Application No. PCT/US07/64104, mailed Dec. 5, 2008.
International Search Report for International (PCT) Patent Application No. PCT/US2007/064106, mailed Sep. 16, 2008.
Written Opinion for International (PCT) Patent Applicationn No. PCT/US2007/064106, mailed Sep. 16, 2008.
International Preliminary Report on Patentability for International (PCT) Patent Application No. PCT/US2007/064106, mailed Oct. 30, 2008.
Fan K W et al: "Eicosapentaenoic and docosahexaenoic acids production by and okara-utilizing potential of thraustochytrids" Journal of Industrial Microbiology and Biotechnology, Basingstoke, GB, vol. 27, No. 4, Oct. 1, 2001, pp. 199-202, XP002393382 ISSN: 1367-5435.
Grimsley et al, "Fatty acid composition of mutants of the moss *Physcomitrella patens*" Phytochemistry 20(7): 1519-1524, 1981.
Wolff et al, Arachidonic, Eicosapentaenoic and Biosynthetically Related Fatty Acids in Seed Lipids from a primitive Gymnosperm, *Agathis robusta*. Lipids 34(10), 1994, 1083-1097.
Sequence alignment for SEQ ID No. 5 with SEQID No. 17 from US Patent 5,683,898. Search resulted dated Aug. 5, 2009.
Sequence alignment for SEQ ID No. 1 with SEQID No. 16 from US Patent 5,683,898. Search resulted dated Aug. 5, 2009.
Sequence alignment of SEQ ID No. 7 with SEQID No. 1 of Yazawa, US Patent 5,798,259, search result date Aug. 10, 2009.
Sequence alignment of SEQ ID No. 11 with SEQID No. 16 of Yazawa, US Patent 5,798,259, search result date Aug. 10, 2009.

* cited by examiner

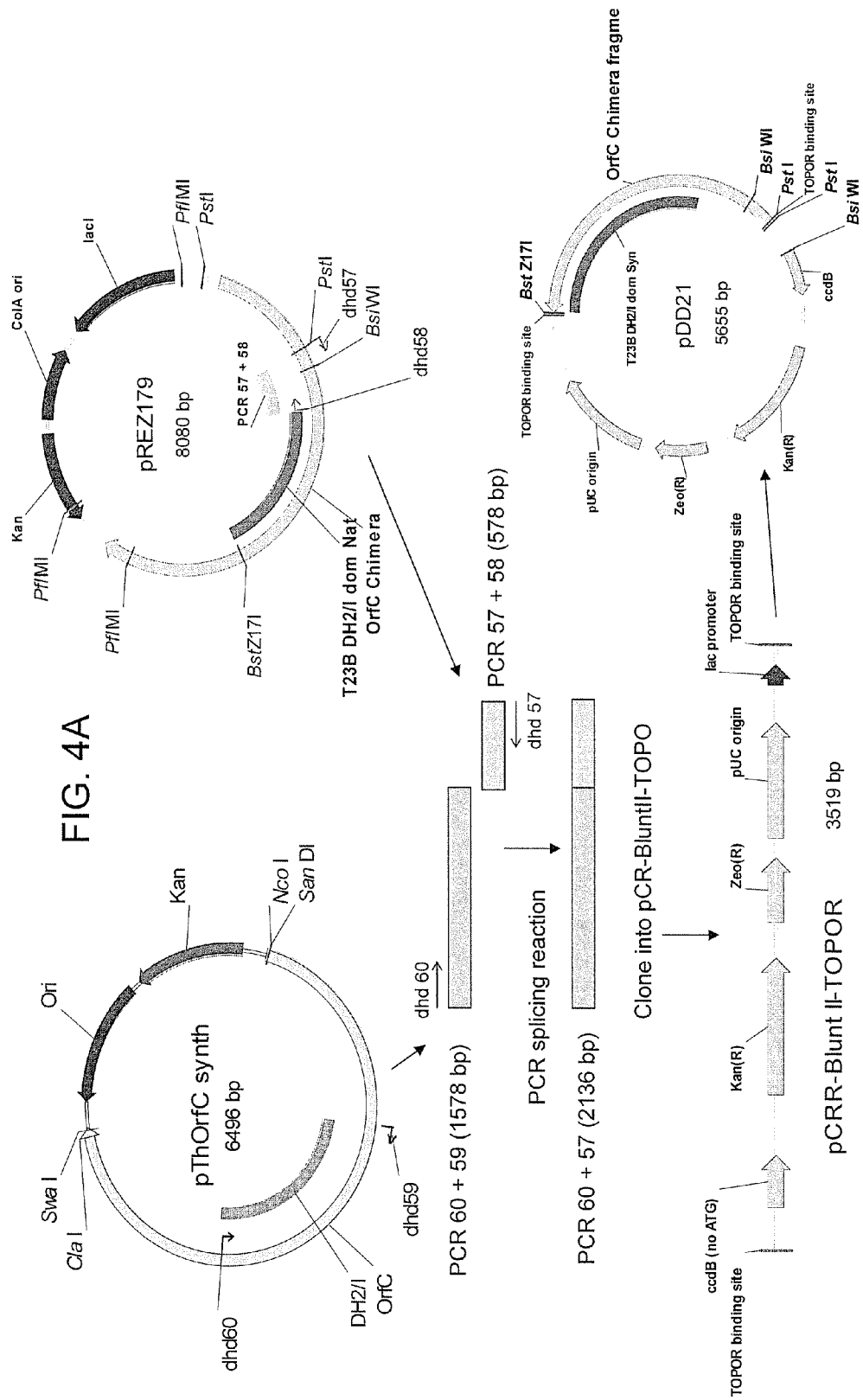
FIG. 4A Step 1: Construction of pDD21

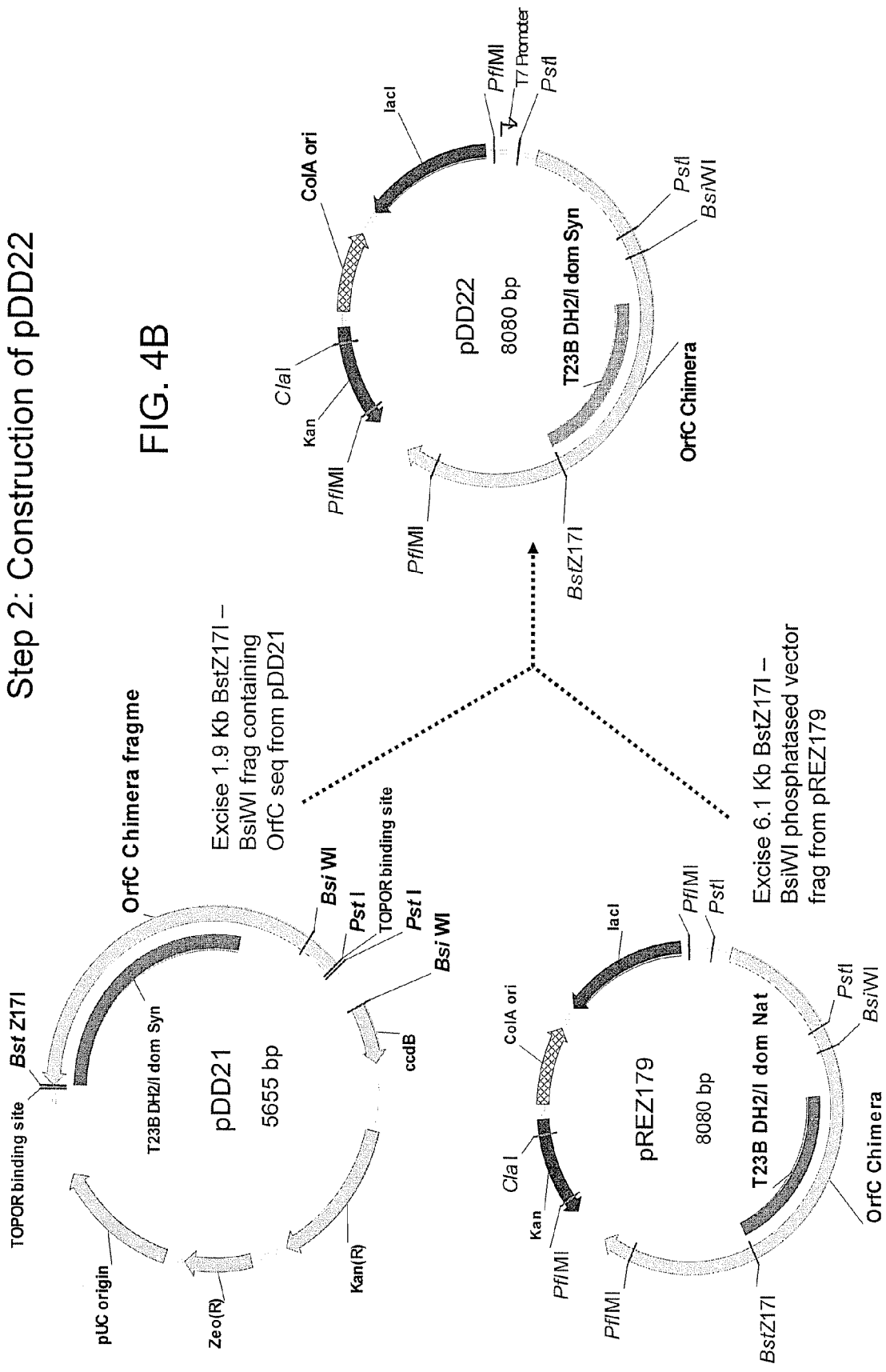

Step 3: Construction of pDD24

US 8,003,772 B2

CHIMERIC PUFA POLYKETIDE SYNTHASE SYSTEMS AND USES THEREOF

CROSS-REFERENCE TO RELATED APPLICATIONS

This application is a continuation-in-part under 35 U.S.C. §120 of U.S. patent application Ser. No. 11/689,438, filed Mar. 21, 2007, now abandoned, which is a continuation of U.S. patent application Ser. No. 10/965,017, filed Oct. 13, 2004, now U.S. Pat. No. 7,217,856, which is a continuation-in-part of U.S. patent application Ser. No. 10/810,352, filed Mar. 26, 2004, now U.S. Pat. No. 7,211,418, which claims the benefit of priority under 35 U.S.C. §119(e) from U.S. Provisional Application Ser. No. 60/457,979, filed Mar. 26, 2003. U.S. patent application Ser. No. 10/810,352, supra, is also a continuation-in-part under 35 U.S.C. §120 of U.S. patent application Ser. No. 10/124,800, filed Apr. 16, 2002, now U.S. Pat. No. 7,247,461, which claims the benefit of priority under 35 U.S.C. §119(e) to: U.S. Provisional Application Ser. No. 60/284,066, filed Apr. 16, 2001; U.S. Provisional Application Ser. No. 60/298,796, filed Jun. 15, 2001; and U.S. Provisional Application Ser. No. 60/323,269, filed Sep. 18, 2001. U.S. patent application Ser. No. 10/124,800, supra, is also a continuation-in-part of U.S. application Ser. No. 09/231,899, filed Jan. 14, 1999, now U.S. Pat. No. 6,566,583.

This application is also a continuation-in-part under 35 U.S.C. §120 of U.S. application Ser. No. 11/668,333, filed Jan. 29, 2007, now abandoned, which is a continuation of U.S. patent application Ser. No. 11/452,096, filed Jun. 12, 2006, now abandoned, which claims the benefit of priority under 35 U.S.C. §119(e) from U.S. Provisional Application No. 60/784,616, filed Mar. 21, 2006, and from U.S. Provisional Application No. 60/689,167, filed Jun. 10, 2005.

This application is also a continuation-in-part under 35 U.S.C. §120 of U.S. patent application Ser. No. 11/452,138, filed Jun. 12, 2006, now U.S. Pat. No. 7,271,315 which claims the benefit of priority under 35 U.S.C. §119(e) from U.S. Provisional Application No. 60/784,616, filed Mar. 21, 2006, and from U.S. Provisional Application No. 60/689,167, filed Jun. 10, 2005, and which is a continuation-in-part of U.S. patent application Ser. No. 10/124,800, filed Apr. 16, 2002, supra.

Each of the above-identified patent applications is incorporated herein by reference in its entirety.

This application does not claim the benefit of priority from U.S. application Ser. No. 09/090,793, filed Jun. 4, 1998, now U.S. Pat. No. 6,140,486, although U.S. application Ser. No. 09/090,793 is incorporated herein by reference in its entirety.

FIELD OF THE INVENTION

This invention relates to chimeric polyunsaturated fatty acid (PUFA) polyketide synthase (PKS) systems, and particularly, to chimeric PUFA PKS systems from *Schizochytrium* and *Thraustochytrium*. More particularly, this invention relates to nucleic acids encoding such PUFA PKS systems, to these PUFA PKS systems, to genetically modified organisms comprising such PUFA PKS systems, and to methods of making and using such PUFA PKS systems disclosed herein.

BACKGROUND OF THE INVENTION

Polyketide synthase (PKS) systems are generally known in the art as enzyme complexes related to fatty acid synthase (FAS) systems, but which are often highly modified to produce specialized products that typically show little resemblance to fatty acids. It has now been shown, however, that PKS-like systems, also referred to herein interchangeably as PUFA PKS systems, PUFA synthase systems, or PKS systems for the production of PUFAs, exist in marine bacteria and certain eukaryotic organisms that are capable of synthesizing polyunsaturated fatty acids (PUFAs) from acetyl-CoA and malonyl-CoA. The PUFA PKS pathways for PUFA synthesis in *Shewanella* and another marine bacteria, *Vibrio marinus*, are described in detail in U.S. Pat. No. 6,140,486. The PUFA PKS pathways for PUFA synthesis in the eukaryotic Thraustochytrid, *Schizochytrium*, is described in detail in U.S. Pat. No. 6,566,583. The PUFA PKS pathways for PUFA synthesis in eukaryotes such as members of Thraustochytriales, including the additional description of a PUFA PKS system in *Schizochytrium* and the identification of a PUFA PKS system in *Thraustochytrium*, including details regarding uses of these systems, are described in detail in U.S. Patent Application Publication No. 20020194641, published Dec. 19, 2002, and U.S. Patent Application Publication No. 20070089199, published Apr. 19, 2007. U.S. Patent Application Publication No. 20040235127, published Nov. 25, 2004, discloses the detailed structural description of a PUFA PKS system in *Thraustochytrium*, and further detail regarding the production of eicosapentaenoic acid (C20:5, ω-3) (EPA) and other PUFAs using such systems. U.S. Patent Application Publication No. 20050100995, published May 12, 2005, discloses the structural and functional description of PUFA PKS systems in *Shewanella olleyana* and *Shewanella japonica*, and uses of such systems. These applications also disclose the genetic modification of organisms, including microorganisms and plants, with the genes comprising the PUFA PKS pathway and the production of PUFAs by such organisms. Furthermore, PCT Patent Publication No. WO 05/097982 describes a PUFA PKS system in *Ulkenia*, and U.S. Patent Application Publication No. 20050014231 describes PUFA PKS genes and proteins from *Thraustochytrium aureum*. Each of the above-identified applications is incorporated by reference herein in its entirety.

Researchers have attempted to exploit polyketide synthase (PKS) systems that have been traditionally described in the literature as falling into one of three basic types, typically referred to as: Type I (modular or iterative), Type II, and Type III. For purposes of clarity, it is noted that the Type I modular PKS system has previously also been referred to as simply a "modular" PKS system, and the Type I iterative PKS system has previously also been referred to simply as a "Type I" PKS system. The Type II system is characterized by separable proteins, each of which carries out a distinct enzymatic reaction. The enzymes work in concert to produce the end product and each individual enzyme of the system typically participates several times in the production of the end product. This type of system operates in a manner analogous to the fatty acid synthase (FAS) systems found in plants and bacteria. Type I iterative PKS systems are similar to the Type II system in that the enzymes are used in an iterative fashion to produce the end product. The Type I iterative differs from Type II in that enzymatic activities, instead of being associated with separable proteins, occur as domains of larger proteins. This system is analogous to the Type I FAS systems found in animals and fungi.

In contrast to the Type II systems, in Type I modular PKS systems, each enzyme domain is used only once in the production of the end product. The domains are found in very large proteins and the product of each reaction is passed on to another domain in the PKS protein. Additionally, in the PKS systems described above, if a carbon-carbon double bond is incorporated into the end product, it is usually in the trans configuration.

Type III systems have been more recently discovered and belong to the plant chalcone synthase family of condensing enzymes. Type III PKSs are distinct from type I and type II PKS systems and utilize free acyl-CoA substrates in iterative condensation reactions to usually produce a heterocyclic end product.

Polyunsaturated fatty acids (PUFAs) are considered to be useful for nutritional, pharmaceutical, industrial, and other purposes. The current supply of PUFAs from natural sources and from chemical synthesis is not sufficient for commercial needs. A major current source for PUFAs is from marine fish; however, fish stocks are declining, and this may not be a sustainable resource. Additionally, contamination, from both heavy metals and toxic organic molecules, is a serious issue with oil derived from marine fish. Vegetable oils derived from oil seed crops are relatively inexpensive and do not have the contamination issues associated with fish oils. However, the PUFAs found in commercially developed plant oils are typically limited to linoleic acid (eighteen carbons with 2 double bonds, in the delta 9 and 12 positions—18:2 delta 9,12) and linolenic acid (18:3 delta 9,12,15). In the conventional pathway (i.e., the "standard" pathway or "classical" pathway) for PUFA synthesis, medium chain-length saturated fatty acids (products of a fatty acid synthase (FAS) system) are modified by a series of elongation and desaturation reactions. The substrates for the elongation reaction are fatty acyl-CoA (the fatty acid chain to be elongated) and malonyl-CoA (the source of the 2 carbons added during each elongation reaction). The product of the elongase reaction is a fatty acyl-CoA that has two additional carbons in the linear chain. The desaturases create cis double bonds in the preexisting fatty acid chain by extraction of 2 hydrogens in an oxygen-dependant reaction. The substrates for the desaturases are either acyl-CoA (in some animals) or the fatty acid that is esterified to the glycerol backbone of a phospholipid (e.g. phosphatidylcholine).

Therefore, because a number of separate desaturase and elongase enzymes are required for fatty acid synthesis from linoleic and linolenic acids to produce the more unsaturated and longer chain PUFAs, engineering plant host cells for the expression of PUFAs such as EPA and docosahexaenoic acid (DHA) may require expression of several separate enzymes to achieve synthesis. Additionally, for production of useable quantities of such PUFAs, additional engineering efforts may be required. Therefore, it is of interest to obtain genetic material involved in PUFA biosynthesis from species that naturally produce these fatty acids (e.g., from a PUFA PKS system) and to express the isolated material alone or in combination in a heterologous system which can be manipulated to allow production of commercial quantities of PUFAs.

There have been many efforts to produce PUFAs in oil-seed crop plants by modification of the endogenously-produced fatty acids. Genetic modification of these plants with various individual genes for fatty acid elongases and desaturases has produced leaves or seeds containing measurable levels of PUFAs such as EPA, but also containing significant levels of mixed shorter-chain and less unsaturated PUFAs (Qi et al., *Nature Biotech.* 22:739 (2004); PCT Publication No. WO 04/071467; Abbadi et al., *Plant Cell* 16:1 (2004)); Napier and Sayanova, Proceedings of the Nutrition Society (2005), 64:387-393; Robert et al., Functional Plant Biology (2005) 32:473-479; or U.S. Patent Application Publication 2004/0172682.

Improvement in both microbial and plant production of PUFAs is a highly desirable commercial goal. Therefore, there remains a need in the art for a method to efficiently and effectively produce quantities of lipids (e.g., triacylglycerol (TAG) and phospholipid (PL)) enriched in desired PUFAs, particularly in commercially useful organisms such as microorganisms and oil-seed plants.

SUMMARY OF THE INVENTION

One embodiment of the invention relates to a chimeric PUFA PKS system, wherein an FabA-like β-hydroxyacyl-ACP dehydrase (DH) domain from a first PUFA PKS system is replaced with a DH domain from a different, second PUFA PKS system, to produce a chimeric PUFA PKS system that produces a different ratio of omega-3 to omega-6 PUFAs as compared to the first PUFA PKS system. In one aspect, a protein comprising the DH domain from the first PUFA PKS system is replaced with a homologous protein comprising the DH domain from the second PUFA PKS system. In one aspect, the DH domain from the first or second PUFA PKS system corresponds to a DH2 domain from *Schizochytrium* or *Thraustochytrium*. In one aspect, the first PUFA PKS system is a *Schizochytrium* PUFA PKS system, and wherein the second PUFA PKS system is a *Thraustochytrium* PUFA PKS system. In one aspect, the first PUFA PKS system is a *Schizochytrium* PUFA PKS system, and wherein OrfC from the *Schizochytrium* PUFA PKS system is replaced with OrfC from a different thraustochytrid.

In one aspect of this embodiment, the first PUFA PKS system is a *Schizochytrium* PUFA PKS system, and wherein OrfC from the *Schizochytrium* PUFA PKS system is replaced with OrfC from *Thraustochytrium* 23B. In one aspect, such an OrfC from *Thraustochytrium* 23B is encoded by a nucleic acid sequence that is optimized for *Schizochytrium* codon usage. An exemplary nucleic acid sequence comprises SEQ ID NO:70. In an additional aspect, OrfA from the *Schizochytrium* PUFA PKS system is replaced with OrfA from *Thraustochytrium* 23B. In one aspect, such an OrfA from *Thraustochytrium* 23B is encoded by a nucleic acid sequence that is optimized for *Schizochytrium* codon usage. An exemplary nucleic acid sequence comprises SEQ ID NO:71. In another additional aspect, OrfB from the *Schizochytrium* PUFA PKS system is replaced with OrfB from *Thraustochytrium* 23B. In one aspect, such an OrfB from *Thraustochytrium* 23B is encoded by a nucleic acid sequence that is optimized for *Schizochytrium* codon usage. An exemplary nucleic acid sequence comprises SEQ ID NO:72. Other combinations of OrfsA, B and C will be apparent based on this disclosure to those of skill in the art.

In yet another aspect of this embodiment, the first PUFA PKS system is a *Schizochytrium* PUFA PKS system, and the DH2 domain of OrfC from the *Schizochytrium* PUFA PKS system is replaced with the DH2 domain from *Thraustochytrium* 23B. In one aspect, an exemplary nucleic acid sequence comprising the DH2 domain from *Thraustochytrium* 23B comprises SEQ ID NO:73. In one aspect, the DH2 domain from *Thraustochytrium* 23B is encoded by a nucleic acid sequence that is optimized for *Schizochytrium* codon usage. Such a nucleic acid sequence comprising the DH2 domain from *Thraustochytrium* 23B is exemplified by the nucleic acid sequence comprising SEQ ID NO:75.

In yet another aspect of this embodiment, the chimeric PUFA PKS system comprises a protein comprising an amino acid sequence that is at least 95% identical to SEQ ID NO:74. In one aspect, the chimeric PUFA PKS system comprises a protein comprising an amino acid sequence of SEQ ID NO:74. In one aspect, the chimeric PUFA PKS system comprises SEQ ID NO:2, SEQ ID NO:4 and SEQ ID NO:74. In another aspect, the chimeric PUFA PKS system comprises SEQ ID NO:39, SEQ ID NO:4 and SEQ ID NO:62. In another aspect, the chimeric PUFA PKS system comprises SEQ ID NO:39, SEQ ID NO:4 and SEQ ID NO:74. In another aspect, the chimeric PUFA PKS system is encoded by nucleic acid molecules comprising: SEQ ID NO:1, SEQ ID NO:3 and SEQ ID NO:70. In yet another aspect, the chimeric PUFA PKS system is encoded by nucleic acid molecules comprising: SEQ ID NO:1, SEQ ID NO:3 and SEQ ID NO:73. In another aspect, the chimeric PUFA PKS system is encoded by nucleic acid molecules comprising: SEQ ID NO:1, SEQ ID NO:3 and SEQ ID NO:75. In another aspect, the chimeric PUFA PKS system is encoded by nucleic acid molecules comprising: SEQ ID NO:71, SEQ ID NO:3 and SEQ ID NO:70.

Another embodiment of the invention relates to a method of altering the omega-3 to omega-6 ratio of polyunsaturated fatty acids (PUFAs) produced by a first PUFA PKS system, comprising expressing any of the above-described chimeric PUFA PKS systems in an organism. In one aspect, the chimeric PUFA PKS system is expressed by a microorganism. In one aspect, the microorganism is a *Schizochytrium*. In yet another aspect, the microorganism is a yeast. In one aspect, the chimeric PUFA PKS system is expressed by a plant.

Yet another embodiment of the invention relates to a genetically modified microorganism or plant or part of the plant, comprising any of the above-described chimeric PUFA PKS systems.

Another embodiment of the invention relates to a method of increasing the production of PUFAs and of altering the omega-3 to omega-6 ratio of polyunsaturated fatty acids (PUFAs) produced by a first PUFA PKS system. The method comprises expressing a chimeric PUFA PKS system in an organism, wherein the FabA-like β-hydroxyacyl-ACP dehydrase (DH) domain from a first PUFA PKS system is replaced with a DH domain from a different, second PUFA PKS system, to produce a chimeric PUFA PKS system that produces a different ratio of omega-3 to omega-6 PUFAs as compared to the first PUFA PKS system. The DH domain from the second PUFA PKS system is optimized for the codon usage of the organism from which the first PUFA PKS system is derived.

Yet another embodiment of the invention relates to an isolated nucleic acid molecule encoding a chimeric OrfC protein that is at least 95% identical to SEQ ID NO:74. In one aspect, the isolated nucleic acid molecule comprises a nucleic acid sequence that is at least 95% identical to SEQ ID NO:73. In one aspect, the nucleic acid sequence is optimized for the codon usage of an organism in which the nucleic acid molecule is to be expressed. As an example, the nucleic acid sequence may be optimized for the codon usage of an organism from which a portion of the chimeric protein is derived. In one embodiment, the nucleic acid sequence is at least 95% identical to SEQ ID NO:75.

Another embodiment of the invention relates to a recombinant nucleic acid molecule comprising any of the above-described nucleic acid molecules.

Yet another embodiment of the invention relates to a recombinant host cell that has been transfected with any of the above-described nucleic acid molecules. In one aspect, cell is a microorganism. In one aspect, the microorganism is a *Schizochytrium*. In one aspect, the microorganism is a bacterium. In one aspect, the microorganism is a yeast. In one aspect, the cell is a plant cell.

Another embodiment of the invention relates to a genetically modified plant or part thereof, comprising any of the above-described recombinant host cells.

Another embodiment of the invention relates to a chimeric PUFA PKS system, comprising: (a) at least one enoyl-ACP reductase (ER) domain; (b) at least four ACP domains; (c) at least two β-ketoacyl-ACP synthase (KS) domains; (d) at least one acyltransferase (AT) domain; (e) at least one β-ketoacyl-ACP reductase (KR) domain; (f) at least two FabA-like β-hydroxyacyl-ACP dehydrase (DH) domains; (g) at least one chain length factor (CLF) domain; and (h) at least one malonyl-CoA:ACP acyltransferase (MAT) domain. At least one of the DH domains is from a first PUFA PKS system, and the remainder of domains (a)-(h) are from a second, different PUFA PKS system.

Another embodiment of the invention relates to a method of increasing PUFA production by an organism that expresses a PUFA PKS system. The method includes modifying a nucleic acid molecule encoding at least one protein in the PUFA PKS system for the optimized codon usage of the organism or of a related organism. In one aspect, the organism expresses a heterologous, recombinant PUFA PKS system. In one aspect, the organism is a *Schizochytrium* and a nucleic acid molecule encoding at least one protein in the endogenous PUFA PKS system is optimized for *Schizochytrium* codon usage.

BRIEF DESCRIPTION OF THE FIGURES

FIG. 4A is a schematic drawing showing the construction of plasmid DD21 as the first step in the construction of a plasmid encoding *Schizochytrium* OrfC comprising a synthetic, *Schizochytrium* codon-optimized DH2 domain from *Thraustochytrium* 23B (pDD24), as well as intermediate plasmids produced by the process.

FIG. 4B is a schematic drawing showing the construction of plasmid DD22 as the second step in the construction of a plasmid encoding *Schizochytrium* OrfC comprising a synthetic, *Schizochytrium* codon-optimized DH2 domain from *Thraustochytrium* 23B (pDD24), as well as intermediate plasmids produced by the process.

DETAILED DESCRIPTION OF THE INVENTION

Figure 1:
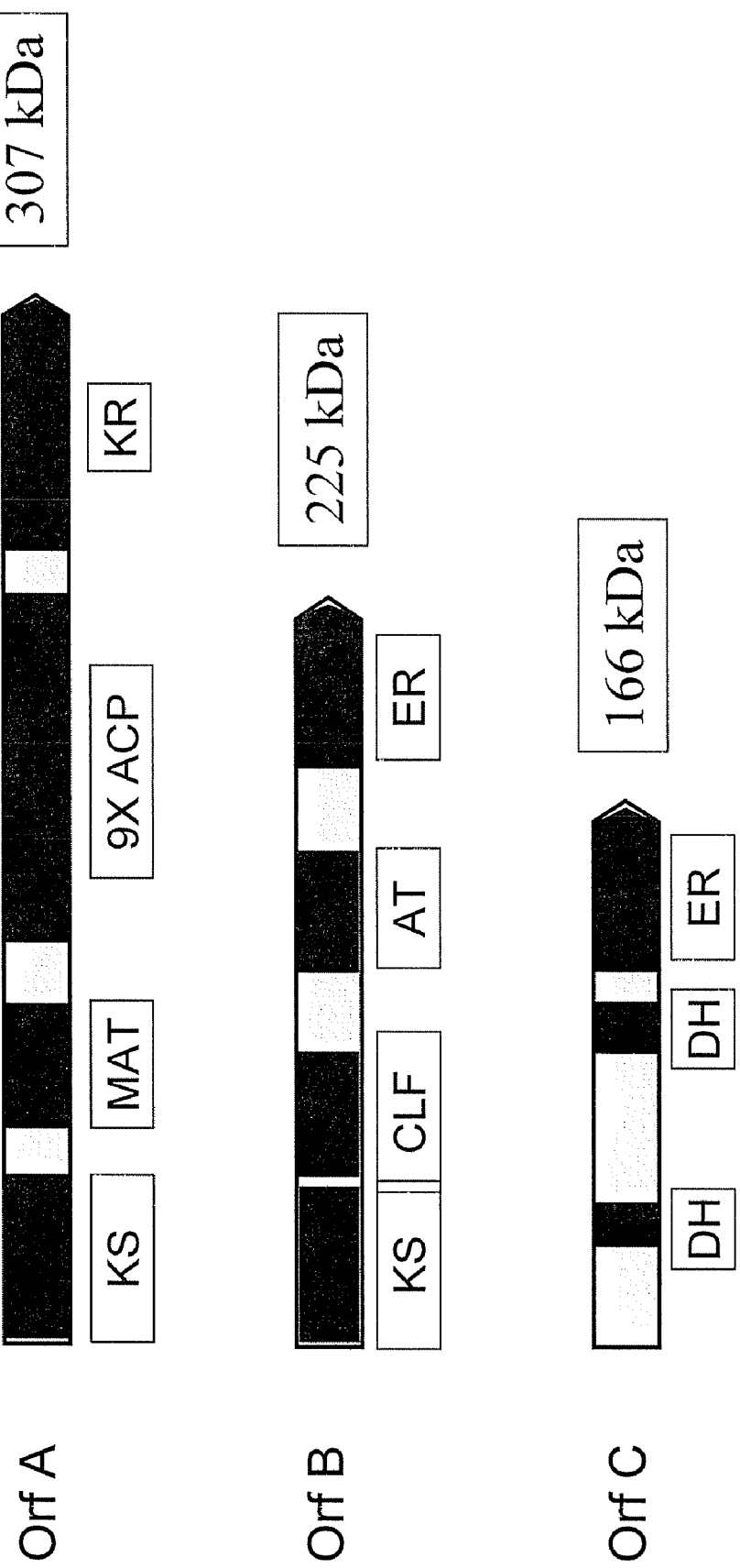
FIG. 1 is a graphical representation of the domain structure of the *Schizochytrium* PUFA PKS system.

The present invention generally relates to polyunsaturated fatty acid (PUFA) polyketide synthase (PKS) systems, also known as PUFA synthase systems, including PUFA PKS systems from thraustochytrids (e.g., *Schizochytrium* and *Thraustochytrium*), labyrinthulids, marine bacteria, and other PUFA PKS-containing organisms, and chimeric PUFA PKS proteins and systems produced therefrom. The present invention relates to genetically modified organisms comprising such PUFA PKS systems, and to methods of making and using such systems for the production of products of interest, including bioactive molecules. In one preferred embodiment, the present invention relates to a method to produce PUFAs in a microorganism or in an oil-seed plant or plant part that has been genetically modified to express a PUFA PKS system of the present invention. The oils produced by the microorganism or plant contain at least one PUFA produced by the PUFA PKS system, and in the case of the plant, are substantially free of the mixed shorter-chain and less unsaturated PUFAs that are fatty acid products produced by the modification of products of the FAS system. The present invention specifically includes methods to modify the amount of PUFAs and the ratio of PUFAs produced by a PUFA PKS system, and in one aspect of the invention, the ratio of omega-3 to omega-6 PUFAs or the ratio of one PUFA to another PUFA(s) (e.g., the ratio of DHA to EPA), which can be applied to the creation and use of any PUFA PKS construct and/or genetically modified organism, as exemplified and described in detail herein.

First, the present inventors describe herein a domain of a PUFA PKS system that is both necessary and sufficient for modifying the ratio of PUFAs that are produced by a PUFA PKS system when more than one PUFA is produced, and provide novel chimeric constructs, novel chimeric PUFA PKS systems, novel organisms, and novel methods for producing modified amounts of PUFAs using this discovery. Second, the present inventors describe herein methods, modifications, and a variety of chimeric PUFA PKS systems and constructs for optimizing PUFA PKS expression in heterologous hosts (or in an endogenous host) to increase the PUFA production by the organism. The invention includes a detailed description of the use of these two discoveries, alone or together, to enhance and direct PUFA production in an organism.

More particularly, with regard to certain embodiments of the invention, previous work by the present inventors and colleagues (see Example 8 in U.S. Patent Application Publication No. 20050100995) demonstrated that the *Thraustochytrium* 23B orfC coding region (represented herein by SEQ ID NO:62) could functionally replace the *Schizochytrium* orfC coding region in the orfC locus in the genome. This was determined by first creating an exact deletion of the *Schizochytrium* orfC coding region containing an antibiotic resistance cassette in its place (denoted ΔorfC:: ZEO) resulting in a strain (denoted B32-Z1) with an obligate growth requirement for DHA and resistance to Zeocin™. A plasmid in which the Th.23B orfC coding region was cloned exactly between *Schizochytrium* orfC upstream and downstream non-coding regions was then constructed. Transformation of the *Schizochytrium* ΔorfC::ZEO strain with this Th.23B orfC construct resulted in complementation of the deletion and prototrophic (non-DHA-requiring), Zeocin-sensitive transformants. It was determined that these transformants derived from double cross-over recombination events at the orfC locus such that the Th.23B orfC coding region had exactly substituted for that from *Schizochytrium*; i.e., gene replacement. Analysis of the fatty acid content of these transformants showed that the DHA/DPA ratio had been changed from ca. 2.3 (in wild type *Schizochytrium* ATCC20888) to ca. 8.3 (approximately that of Th.23B). This result indicated that the orfC gene (containing three domains, DH1, DH2 and ER, in *Schizochytrium* and *Thraustochytrium*) plays a major role in determining the n-3/n-6 (omega-3/omega-6) ratio of PUFA products. However, total PUFA production in the Th.23B orfC-containing strain, while significant, was lower than that of the wild-type *Schizochytrium* host (ca. 60%).

Examination of these two orfC coding regions led the inventors to consider that the Th.23B gene is poorly expressed in *Schizochytrium* due to notably different patterns of codon usage between *Schizochytrium* and *Thraustochytrium*. The inventors have now discovered that by using a "synthetic" Th.23B orfC coding region (i.e., a synthetically produced coding region) with codon usage optimized for the *Schizochytrium* pattern, DHA production was enhanced, while the increased n-3/n-6 ratio seen with the non-synthetic Th.23B orfC was maintained (see Examples 1 and 4).

The inventors have also previously described the existence of identifiable domains within the OrfC protein for *Schizochytrium* and *Thraustochytrium*: dehydratase 1 (DH1), dehydratase 2 (DH2), and enoyl reductase (ER) (e.g., see U.S. Patent Application Publication No. 20020194641, supra; U.S. Patent Application Publication No. 20040235127, supra), and have taught that one or more of the domains in OrfC were believed to be involved in controlling the type and/or ratio of fatty acids produced by the PUFA PKS system. Here, the inventors demonstrate in *Schizochytrium*, *E. coli*, and yeast systems that the DH2 domain alone is responsible for most or all of the effect of the PUFA PKS system on the omega-3 to omega-6 (n-3/n-6) fatty acid ratio. In particular, the inventors first performed experiments in which various *Thraustochytrium* 23B OrfC domains were used to replace the corresponding domains in *Schizochytrium* OrfC (data not shown). The inventors found that replacement of the *Schizochytrium* OrfC-ER domain with that from *Thraustochytrium* did not significantly change the DHA/DPA ratio as compared to wild-type *Schizochytrium* (historically, approximately 2.3). However, replacement of both *Schizochytrium* DH domains with the corresponding domains from *Thraustochytrium* significantly increased the DHA/ DPA ratio toward that of wild-type *Thraustochytrium* 23B (historically, approximately 8.3-10), and replacement of just the *Schizochytrium* DH2 domain with that from *Thraustochytrium* 23B, was sufficient to achieve effectively the same result. Examples 2, 3, 4, 5, and 6 provide a variety of experimental results demonstrating the effect of the DH2 domain on the omega-3 to omega-6 (n-3/n-6) fatty acid ratio in PUFA PKS systems.

The present inventors also describe the use of a variety of chimeric PUFA PKS systems to increase the production of PUFAs by the host organism, and have made the unexpected discovery that certain chimeric PUFA PKS combinations (e.g., chimeric PUFA PKS systems comprised of particular combinations of Orfs from *Schizochytrium* and *Thraustochytrium*) have significantly higher PUFA production, and in one example, DHA production, than the native organisms or than other chimeric PUFA PKS systems. For example, the inventors demonstrate that a chimeric PUFA PKS system comprised of an OrfA and OrfC from *Thraustochytrium* 23B and an OrfB from *Schizochytrium*, when expressed in a *Schizochytrium* host organism, produces significantly more fatty acids and significantly more DHA specifically, than native *Schizochytrium* or than other chimeric PUFA PKS systems derived from these two organisms (Example 8). Accordingly, the invention provides substantial guidance on the production of several different PUFA PKS systems that have increased PUFA production and improved n-3/n-6 ratios, as compared to some wild-type (non-chimeric) PUFA synthases.

As used herein, a PUFA PKS system (which may also be referred to as a PUFA synthase system, a PUFA synthase, or a PKS-like system for the production of PUFAs) generally has the following identifying features: (1) it produces PUFAs, and particularly, long chain PUFAs, as a natural product of the system; and (2) it comprises several multifunctional proteins assembled into a complex that conducts both iterative processing of the fatty acid chain as well non-iterative processing, including trans-cis isomerization and enoyl reduction reactions in selected cycles. In addition, the ACP domains present in the PUFA synthase enzymes require activation by attachment of a cofactor (4-phosphopantetheine). Attachment of this cofactor is carried out by phosphopantetheinyl transferases (PPTase). If the endogenous PPTases of the host organism are incapable of activating the PUFA synthase ACP domains, then it is necessary to provide a PPTase that is capable of carrying out that function. The inventors have identified the Het I enzyme of *Nostoc* sp. as an exemplary and suitable PPTase for activating PUFA synthase ACP domains. Reference to a PUFA PKS system or a PUFA synthase refers collectively to all of the genes and their encoded products that work in a complex to produce PUFAs in an organism. Therefore, the PUFA PKS system refers specifically to a PKS system for which the natural products are PUFAs.

More specifically, a PUFA PKS system as referenced herein produces polyunsaturated fatty acids (PUFAs) and particularly, long chain PUFAs, as products. For example, an organism that endogenously (naturally) contains a PUFA PKS system makes PUFAs using this system. According to the present invention, PUFAs are fatty acids with a carbon chain length of at least 16 carbons, and more preferably at least 18 carbons, and more preferably at least 20 carbons, and more preferably 22 or more carbons, with at least 3 or more double bonds, and preferably 4 or more, and more preferably 5 or more, and even more preferably 6 or more double bonds, wherein all double bonds are in the cis configuration. Reference to long chain polyunsaturated fatty acids (LCPUFAs) herein more particularly refers to fatty acids of 18 and more carbon chain length, and preferably 20 and more carbon chain length, containing 3 or more double bonds. LCPUFAs of the omega-6 series include: gamma-linolenic acid (C18:3), di-homo-gamma-linolenic acid (C20:3n-6), arachidonic acid (C20:4n-6), adrenic acid (also called docosatetraenoic acid or DTA) (C22:4n-6), and docosapentaenoic acid (C22:5n-6). The LCPUFAs of the omega-3 series include: alpha-linolenic acid (C18:3), eicosatrienoic acid (C20:3n-3), eicosatetraenoic acid (C20:4n-3), eicosapentaenoic acid (C20:5n-3), docosapentaenoic acid (C22:5n-3), and docosahexaenoic acid (C22:6n-3). The LCPUFAs also include fatty acids with greater than 22 carbons and 4 or more double bonds including but not limited to C28:8(n-3).

Second, a PUFA PKS system according to the present invention comprises several multifunctional proteins (and can include single function proteins, particularly for PUFA PKS systems from marine bacteria) that are assembled into a complex that conducts both iterative processing of the fatty acid chain as well non-iterative processing, including trans-cis isomerization and enoyl reduction reactions in selected cycles. These proteins can also be referred to herein as the core PUFA PKS enzyme complex or the core PUFA PKS system. The general functions of the domains and motifs contained within these proteins are individually known in the art and have been described in detail with regard to various PUFA PKS systems from marine bacteria and eukaryotic organisms (see, e.g., U.S. Pat. No. 6,140,486; U.S. Pat. No. 6,566,583; Metz et al., *Science* 293:290-293 (2001); U.S. Patent Application Publication No. 20020194641; U.S. Patent Application Publication No. 20040235127; U.S. Patent Application Publication No. 20050100995, and PCT Publication No. WO 2006/135866). The domains may be found as a single protein (i.e., the domain and protein are synonymous) or as one of two or more (multiple) domains in a single protein, as mentioned above.

Before the discovery of a PUFA PKS system in marine bacteria (see U.S. Pat. No. 6,140,486), PKS systems were not known to possess this combination of iterative and selective enzymatic reactions, and they were not thought of as being able to produce carbon-carbon double bonds in the cis configuration. However, the PUFA PKS system described by the present invention has the capacity to introduce cis double bonds and the capacity to vary the reaction sequence in the cycle.

The present inventors propose to use these features of the PUFA PKS system to produce a range of bioactive molecules that could not be produced by the previously described (Type I iterative or modular, Type II, or Type III) PKS systems. These bioactive molecules include, but are not limited to, polyunsaturated fatty acids (PUFAs), antibiotics or other bioactive compounds, many of which will be discussed below. For example, using the knowledge of the PUFA PKS gene structures described herein, any of a number of methods can be used to alter the PUFA PKS genes, or combine portions of these genes with other synthesis systems, including other PKS systems, such that new products are produced. The inherent ability of this particular type of system to do both iterative and selective reactions will enable this system to yield products that would not be found if similar methods were applied to other types of PKS systems.

Preferably, a PUFA PKS system of the present invention comprises at least the following biologically active domains that are typically contained on three or more proteins: (a) at least one enoyl-ACP reductase (ER) domain; (b) multiple acyl carrier protein (ACP) domain(s) (e.g., at least from one to four, and preferably at least five ACP domains, and in some embodiments up to six, seven, eight, nine, ten, or more than ten ACP domains); (c) at least two β-ketoacyl-ACP synthase (KS) domains; (d) at least one acyltransferase (AT) domain; (e) at least one β-ketoacyl-ACP reductase (KR) domain; (f) at least two FabA-like β-hydroxyacyl-ACP dehydrase (DH) domains; (g) at least one chain length factor (CLF) domain; (h) at least one malonyl-CoA:ACP acyltransferase (MAT) domain. In one embodiment, a PUFA PKS system according to the present invention also comprises at least one region containing a dehydratase (DH) conserved active site motif.

In one embodiment, a *Schizochytrium* PUFA PKS system comprises at least the following biologically active domains: (a) two enoyl-ACP reductase (ER) domain; (b) between four or five and ten or more acyl carrier protein (ACP) domains, and in one aspect, nine ACP domains; (c) two β-ketoacyl-ACP synthase (KS) domains; (d) one acyltransferase (AT) domain; (e) one β-ketoacyl-ACP reductase (KR) domain; (f) two FabA-like β-hydroxyacyl-ACP dehydrase (DH) domains; (g) one chain length factor (CLF) domain; and (h) one malonyl-CoA:ACP acyltransferase (MAT) domain. In one embodiment, a *Schizochytrium* PUFA PKS system according to the present invention also comprises at least one region or domain containing a dehydratase (DH) conserved active site motif that is not a part of a FabA-like DH domain. The structural and functional characteristics of these domains are generally individually known in the art and will be described in detail below with regard to the PUFA PKS systems of the present invention.

In another preferred embodiment, a *Thraustochytrium* PUFA PKS system comprises at least the following biologically active domains: (a) two enoyl-ACP reductase (ER) domain; (b) between four or five and ten or more acyl carrier protein (ACP) domains, and in one aspect, eight ACP domains; (c) two β-ketoacyl-ACP synthase (KS) domains; (d) one acyltransferase (AT) domain; (e) one β-ketoacyl-ACP reductase (KR) domain; (f) two FabA-like β-hydroxyacyl-ACP dehydrase (DH) domains; (g) one chain length factor (CLF) domain; and (h) one malonyl-CoA:ACP acyltransferase (MAT) domain. In one embodiment, a *Thraustochytrium* PUFA PKS system according to the present invention also comprises at least one region or domain containing a dehydratase (DH) conserved active site motif that is not a part of a FabA-like DH domain. The structural and functional characteristics of these domains are generally individually known in the art and will be described in detail below with regard to the PUFA PKS systems of the present invention.

A PUFA PKS system can additionally include one or more accessory proteins, which are defined herein as proteins that are not considered to be part of the core PUFA PKS system as described above (i.e., not part of the PUFA synthase enzyme complex itself), but which may be, or are, necessary for PUFA production or at least for efficient PUFA production using the core PUFA synthase enzyme complex of the present invention, particularly in certain host organisms (e.g., plants). For example, in order to produce PUFAs, a PUFA PKS system must work with an accessory protein that transfers a 4'-phosphopantetheinyl moiety from coenzyme A to the acyl carrier protein (ACP) domain(s). Therefore, a PUFA PKS system can be considered to include at least one 4'-phosphopantetheinyl transferase (PPTase) domain, or such a domain can be considered to be an accessory domain or protein to the PUFA PKS system. When genetically modifying organisms (e.g., microorganisms or plants) to express a PUFA PKS system according to the present invention, some host organisms may endogenously express accessory proteins that are needed to work with the PUFA PKS to produce PUFAs (e.g., PPTases). However, some organisms may be transformed with nucleic acid molecules encoding one or more accessory proteins described herein to enable and/or to enhance production of PUFAs by the organism, even if the organism endogenously produces a homologous accessory protein (i.e., some heterologous accessory proteins may operate more effectively or efficiently with the transformed PUFA synthase proteins than the host cells' endogenous accessory protein). The present invention and prior applications provide examples of bacteria and yeast that have been genetically modified with the PUFA PKS system of the present invention that includes an accessory PPTase. Plants that have been genetically modified with the PUFA PKS system that includes an accessory PPTase have been described (see, e.g., U.S. Patent Application Publication No. 20070089199). Structural and functional characteristics of PPTases will be described in more detail below.

The "standard" or "classical" pathway for synthesis of long chain PUFAs (LCPUFAs) in eukaryotic organisms involves the modification of medium chain-length saturated or mono-unsaturated fatty acids (e.g., the products of the FAS system described above). These modifications consist of elongation steps and desaturation steps. The substrates for the elongation reaction are fatty acyl-CoA (the fatty acid chain to be elongated) and malonyl-CoA (the source of the two carbons added during each elongation reaction). The product of the elongase reaction is a fatty acyl-CoA that has two additional carbons in the linear chain. Free fatty acids (FFAs) do not normally occur in this reaction cycle. The desaturases create cis double bonds in the preexisting fatty acid chain by extraction of two hydrogens in an oxygen-dependant reaction. The substrates for the desaturases are either acyl-CoAs (in some animals) or fatty acids that are esterified to the glycerol backbone of a PL (e.g., phosphotidylcholine). Again, FFAs do not occur in this reaction mechanism. Therefore, the only time FFAs occur in "standard" or "classical" LCPUFA synthesis pathways is during release of the fatty acids from some FAS systems. As discussed above, these are typically 16 or 18 carbon fatty acids and usually are either saturated or monounsaturated fatty acids, not longer chain PUFAs such as EPA or DHA. One consequence of this scheme for long chain PUFA production is that intermediates in the pathway often accumulate, often representing the majority of the novel fatty acids produced by the system.

Therefore, according to the present invention, reference to a "standard" or "classical" pathway for the production of PUFAs refers to the fatty acid synthesis pathway where medium chain-length saturated fatty acids (e.g., products of a fatty acid synthase (FAS) system) are modified by a series of elongation and desaturation reactions. The substrates for the elongation reaction are fatty acyl-CoA (the fatty acid chain to be elongated) and malonyl-CoA (the source of the 2 carbons added during each elongation reaction). The product of the elongase reaction is a fatty acyl-CoA that has two additional carbons in the linear chain. The desaturases create cis double bonds in the preexisting fatty acid chain by extraction of 2 hydrogens in an oxygen-dependant reaction. Such pathways and the genes involved in such pathways are well-known in the literature.

As used herein, the term "lipid" includes phospholipids (PL); free fatty acids; esters of fatty acids; triacylglycerols (TAG); diacylglycerides; monoacylglycerides; phosphatides; waxes (esters of alcohols and fatty acids); sterols and sterol esters; carotenoids; xanthophylls (e.g., oxycarotenoids); hydrocarbons; and other lipids known to one of ordinary skill in the art. The terms "polyunsaturated fatty acid" and "PUFA" include not only the free fatty acid form, but other forms as well, such as the TAG form and the PL form.

Reference to a "heterologous" organism or "heterologous" host, with respect to the expression of a PUFA PKS protein, domain or system by the organism/host, means that at least one protein, domain, or portion of the PUFA PKS system is not a protein, domain or portion that is naturally (endogenously) expressed by the organism, although the PUFA PKS system may include proteins, domains, or portions thereof that are naturally expressed by host organism (e.g., a chimeric protein as described herein that contains sequences derived from the host organism and from a different organism or different protein).

Certain exemplary nucleic acid molecules (constructs) encoding various chimeric proteins are described herein (see Examples). According to the present invention, a "chimeric protein" is an engineered protein encoded by a nucleic acid sequence that is produced by splicing or linking (ligating) together two or more complete or partial genes or nucleic acid sequences. A "chimeric PUFA PKS system" is a PUFA PKS system that contains proteins and/or domains, including chimeric proteins and/or domains, from two or more different PKS systems. For example, the Examples describe a chimeric PUFA PKS system comprised of the *Schizochytrium* PUFA PKS OrfA and OrfB and the *Thraustochytrium* PUFA PKS OrfC. The Examples also describe a chimeric PUFA PKS system comprised of the *Schizochytrium* PUFA PKS OrfA, OrfB, and all of OrfC except for the DH2 domain, which is the PUFA PKS DH2 domain from a *Thraustochytrium* PUFA PKS. This latter chimeric PUFA PKS system accordingly comprises a chimeric protein (a chimeric OrfC protein). The same chimeras are also described using *Thraustochytrium* nucleic acid sequences that have been optimized for *Schizochytrium* codon usage, illustrating a combination of genetic manipulations that can be used to alter the product produced by a PUFA PKS system (see Examples). The Examples also describe a variety of other chimeric PUFA PKS systems.

As used herein, "codon optimization" or derivative phrases thereof refer to the process of modifying (altering, changing, mutating) a nucleic acid sequence encoding a given protein to replace one or more codons in the sequence with codons that are most frequently used in nucleic acid sequences of a particular organism in which a nucleic acid molecule comprising the nucleic acid sequence is to be expressed. Codon bias and the general idea of codon optimization are understood by the skilled artisan. More particularly, the degree to which a given codon appears in the genetic code can vary significantly between organisms (e.g., including from species to species within a genus). Any codon that an organism uses a small percentage of the time, or less than another codon for the same amino acid, can cause problems with protein expression. Accordingly, protein expression can improve dramatically when the codon frequency of the nucleic acid sequence being used is matched to that of the host expression system/organism (e.g., by replacing rare or infrequent or less frequently used codons with others that more closely reflect the host system's natural codon bias, without modifying the amino acid sequence).

The present inventors describe herein methods to optimize codon usage of a nucleic acid sequence for that of *Schizochytrium*, although this is just one example of the use of codon optimization in the present invention. According to the present invention, the nucleotide sequence of a nucleic acid molecule encoding a given protein (e.g., a PUFA PKS protein) can be modified (e.g., by synthesis, mutation, recombinant technology, etc.) for the optimal (optimized) codon usage of a host cell or organism in which the nucleic acid molecule is to be expressed, or indeed, for the optimized codon usage of a different organism (e.g., a nucleic acid molecule encoding a *Thraustochytrium* PUFA PKS protein for expression in a plant may be optimized for *Schizochytrium* codon usage). Table 1 of the Examples illustrates optimized codon usage for *Schizochytrium*.

In addition, the inventors propose herein the optimization of the nucleic acid sequence of a nucleic acid molecule encoding a given protein for the same host from which the nucleic acid sequence was derived, learned or obtained, for expression in that host (or in another host). This latter embodiment of the invention represents a "directed" or "accelerated" evolution of sorts, in which, for example, a nucleic acid molecule encoding a protein from an organism (e.g., a PUFA PKS protein from *Schizochytrium*) is modified (e.g., by resynthesizing the nucleic acid sequence and replacing certain nucleotides) to enhance codon usage (optimize the codon usage) that is preferred by the same organism (*Schizochytrium*, in this example). This nucleic acid molecule can then be expressed in *Schizochytrium* (as a recombinant nucleic acid molecule) or in another host cell or organism (e.g., in a plant). In this embodiment, it is proposed that a given nucleic acid sequence from an organism may not use the optimal codons (codon bias) that can be determined for that organism. Accordingly, one may resynthesize the nucleic acid sequence to improve protein expression in that organism.

PUFA PKS systems and proteins or domains thereof that are useful in the present invention include both bacterial and non-bacterial PUFA PKS systems. A non-bacterial PUFA PKS system is a PUFA PKS system that is from or derived from an organism that is not a bacterium, such as a eukaryote or an archaebacterium. Eukaryotes are separated from prokaryotes based on the degree of differentiation of the cells, with eukaryotes being more differentiated than prokaryotes. In general, prokaryotes do not possess a nuclear membrane, do not exhibit mitosis during cell division, have only one chromosome, contain 70S ribosomes in their cytoplasm, do not possess mitochondria, endoplasmic reticulum, chloroplasts, lysosomes or Golgi apparatus, and may have flagella, which if present, contain a single fibril. In contrast, eukaryotes have a nuclear membrane, exhibit mitosis during cell division, have many chromosomes, contain 80S ribosomes in their cytoplasm, possess mitochondria, endoplasmic reticulum, chloroplasts (in algae), lysosomes and Golgi apparatus, and may have flagella, which if present, contain many fibrils. In general, bacteria are prokaryotes, while algae, fungi, protist, protozoa and higher plants are eukaryotes. According to the present invention, genetically modified organisms can be produced which incorporate non-bacterial PUFA PKS functional domains with bacterial PUFA PKS functional domains, as well as PKS functional domains or proteins from other PKS systems (Type I iterative or modular, Type II, or Type III) or FAS systems.

According to the present invention, a domain or protein having 3-keto acyl-ACP synthase (KS) biological activity (function) is characterized as the enzyme that carries out the initial step of the FAS (and PKS) elongation reaction cycle. The term "β-ketoacyl-ACP synthase" can be used interchangeably with the terms "3-keto acyl-ACP synthase", "β-keto acyl-ACP synthase", and "keto-acyl ACP synthase", and similar derivatives. The acyl group destined for elongation is linked to a cysteine residue at the active site of the enzyme by a thioester bond. In the multi-step reaction, the acyl-enzyme undergoes condensation with malonyl-ACP to form -keto acyl-ACP, $CO_2$ and free enzyme. The KS plays a key role in the elongation cycle and in many systems has been shown to possess greater substrate specificity than other enzymes of the reaction cycle. For example, *E. coli* has three distinct KS enzymes—each with its own particular role in the physiology of the organism (Magnuson et al., *Microbiol. Rev.* 57, 522 (1993)). The two KS domains of the PUFA-PKS systems described in marine bacteria and the thraustochytrids described herein may have distinct roles in the PUFA biosynthetic reaction sequence. As a class of enzymes, KS's have been well characterized. The sequences of many verified KS genes are known, the active site motifs have been identified and the crystal structures of several have been determined.

Proteins (or domains of proteins) can be readily identified as belonging to the KS family of enzymes by homology to known KS sequences.

According to the present invention, a domain or protein having malonyl-CoA:ACP acyltransferase (MAT) biological activity (function) is characterized as one that transfers the malonyl moiety from malonyl-CoA to ACP. The term "malonyl-CoA:ACP acyltransferase" can be used interchangeably with "malonyl acyltransferase" and similar derivatives. In addition to the active site motif (GxSxG), these enzymes possess an extended motif of R and Q amino acids in key positions that identifies them as MAT enzymes (e.g., in contrast to an AT domain described below). In some PKS systems (but not the PUFA PKS domain) MAT domains will preferentially load methyl- or ethyl-malonate on to the ACP group (from the corresponding CoA ester), thereby introducing branches into the linear carbon chain. MAT domains can be recognized by their homology to known MAT sequences and by their extended motif structure.

According to the present invention, a domain or protein having acyl carrier protein (ACP) biological activity (function) is characterized as being small polypeptides (typically, 80 to 100 amino acids long), that function as carriers for growing fatty acyl chains via a thioester linkage to a covalently bound co-factor of the protein. They occur as separate units or as domains within larger proteins. ACPs are converted from inactive apo-forms to functional holo-forms by transfer of the phosphopantetheinyl moiety of CoA to a highly conserved serine residue of the ACP. Acyl groups are attached to ACP by a thioester linkage at the free terminus of the phosphopantetheinyl moiety. ACPs can be identified by labeling with radioactive pantetheine and by sequence homology to known ACPs. The presence of variations of the above mentioned motif (LGIDS*) is also a signature of an ACP.

According to the present invention, a domain or protein having ketoreductase activity, also referred to as 3-ketoacyl-ACP reductase (KR) biological activity (function), is characterized as one that catalyzes the pyridine-nucleotide-dependent reduction of 3-keto acyl forms of ACP. It is the first reductive step in the de novo fatty acid biosynthesis elongation cycle and a reaction often performed in polyketide biosynthesis. The term "β-ketoacyl-ACP reductase" can be used interchangeably with the terms "ketoreductase", "3-ketoacyl-ACP reductase", "keto-acyl ACP reductase" and similar derivatives of the term. Significant sequence similarity is observed with one family of enoyl ACP reductases (ER), the other reductase of FAS (but not the ER family present in the PUFA PKS systems), and the short-chain alcohol dehydrogenase family. Pfam analysis of the PUFA PKS region indicated above reveals the homology to the short-chain alcohol dehydrogenase family in the core region. Blast analysis of the same region reveals matches in the core area to known KR enzymes as well as an extended region of homology to domains from the other characterized PUFA PKS systems.

According to the present invention, a domain or protein is referred to as a chain length factor (CLF) based on the following rationale. The CLF was originally described as characteristic of Type II (dissociated enzymes) PKS systems and was hypothesized to play a role in determining the number of elongation cycles, and hence the chain length, of the end product. CLF amino acid sequences show homology to KS domains (and are thought to form heterodimers with a KS protein), but they lack the active site cysteine. CLF's role in PKS systems has been controversial. New evidence (C. Bisang et al., *Nature* 401, 502 (1999)) suggests a role in priming (providing the initial acyl group to be elongated) the PKS systems. In this role the CLF domain is thought to decarboxylate malonate (as malonyl-ACP), thus forming an acetate group that can be transferred to the KS active site. This acetate therefore acts as the 'priming' molecule that can undergo the initial elongation (condensation) reaction. Homologues of the Type II CLF have been identified as 'loading' domains in some modular PKS systems. A domain with the sequence features of the CLF is found in all currently identified PUFA PKS systems and in each case is found as part of a multidomain protein.

An "acyltransferase" or "AT" refers to a general class of enzymes that can carry out a number of distinct acyl transfer reactions. The term "acyltransferase" can be used interchangeably with the term "acyl transferase". The AT domains identified in the PUFA PKS systems described herein show good homology one another and to domains present in all of the other PUFA PKS systems currently examined and very weak homology to some acyltransferases whose specific functions have been identified (e.g. to malonyl-CoA:ACP acyltransferase, MAT). In spite of the weak homology to MAT, this AT domain is not believed to function as a MAT because it does not possess an extended motif structure characteristic of such enzymes (see MAT domain description, above). For the purposes of this disclosure, the possible functions of the AT domain in a PUFA PKS system include, but are not limited to: transfer of the fatty acyl group from the ORFA ACP domain(s) to water (i.e. a thioesterase—releasing the fatty acyl group as a free fatty acid), transfer of a fatty acyl group to an acceptor such as CoA, transfer of the acyl group among the various ACP domains, or transfer of the fatty acyl group to a lipophilic acceptor molecule (e.g. to lysophosphadic acid).

According to the present invention, this domain has enoyl reductase (ER) biological activity. The ER enzyme reduces the trans-double bond (introduced by the DH activity) in the fatty acyl-ACP, resulting in fully saturating those carbons. The ER domain in the PUFA-PKS shows homology to a newly characterized family of ER enzymes (Heath et al., *Nature* 406, 145 (2000)). Heath and Rock identified this new class of ER enzymes by cloning a gene of interest from *Streptococcus pneumoniae*, purifying a protein expressed from that gene, and showing that it had ER activity in an in vitro assay. All of the PUFA PKS systems currently examined contain at least one domain with very high sequence homology to the *Schizochytrium* ER domain, which shows homology to the *S. pneumoniae* ER protein.

According to the present invention, a protein or domain having dehydrase or dehydratase (DH) activity catalyzes a dehydration reaction. As used generally herein, reference to DH activity typically refers to FabA-like β-hydroxyacyl-ACP dehydrase (DH) biological activity. FabA-like β-hydroxyacyl-ACP dehydrase (DH) biological activity removes HOH from a β-ketoacyl-ACP and initially produces a trans double bond in the carbon chain. The term "FabA-like β-hydroxyacyl-ACP dehydrase" can be used interchangeably with the terms "FabA-like β-hydroxy acyl-ACP dehydrase", "β-hydroxyacyl-ACP dehydrase", "dehydrase" and similar derivatives. The DH domains of the PUFA PKS systems show homology to bacterial DH enzymes associated with their FAS systems (rather than to the DH domains of other PKS systems). A subset of bacterial DH's, the FabA-like DH's, possesses cis-trans isomerase activity (Heath et al., *J. Biol. Chem.*, 271, 27795 (1996)). It is the homology to the FabA-like DH proteins that suggests that one or all of the DH domains described herein is responsible for insertion of the cis double bonds in the PUFA PKS products.

A PUFA PKS protein useful of the invention may also have dehydratase activity that is not characterized as FabA-like (e.g., the cis-trans activity described above is associated with FabA-like activity), generally referred to herein as non-FabA-like DH activity, or non-FabA-like β-hydroxyacyl-ACP dehydrase (DH) biological activity. More specifically, a conserved active site motif (~13 amino acids long: L*xxHxxxGxxxxP; *in the motif, L can also be I) is found in dehydratase domains in PKS systems (Donadio S, Katz L. Gene. 1992 Feb. 1; 111(1):51-60). This conserved motif, also referred to herein as a dehydratase (DH) conserved active site motif or DH motif, is found in a similar region of all known PUFA-PKS sequences described to date and in the PUFA PKS sequences described herein, but it is believed that his motif has only recently been detected. This conserved motif is within an uncharacterized region of high homology in the PUFA-PKS sequence. The proposed biosynthesis of PUFAs via the PUFA-PKS requires a non-FabA like dehydration, and this motif may be associated with that reaction.

For purposes of illustration, the structure of certain PUFA PKS systems is described in detail below. However, it is to be understood that this invention is not limited to the use of these PUFA PKS systems. For example, a detailed description of bacterial PUFA PKS systems can be found in U.S. Pat. No. 6,140,486 and U.S. Patent Application Publication No. 20050100995, and a description of other PUFA PKS genes or systems is found in PCT Patent Publication No. WO 05/097982 and U.S. Patent Application Publication No. 20050014231.

Schizochytrium PUFA PKS System

Schizochytrium is a thraustochytrid marine microorganism that accumulates large quantities of triacylglycerols rich in DHA and docosapentaenoic acid (DPA; 22:5 ω-6); e.g., 30% DHA+DPA by dry weight (Barclay et al., J. Appl. Phycol. 6, 123 (1994)). In eukaryotes that synthesize 20- and 22-carbon PUFAs by an elongation/desaturation pathway, the pools of 18-, 20- and 22-carbon intermediates are relatively large so that in vivo labeling experiments using [$^{14}$C]-acetate reveal clear precursor-product kinetics for the predicted intermediates (Gellerman et al., Biochim. Biophys. Acta 573:23 (1979)). Furthermore, radiolabeled intermediates provided exogenously to such organisms are converted to the final PUFA products. The present inventors have shown that [1-$^{14}$C]-acetate was rapidly taken up by Schizochytrium cells and incorporated into fatty acids, but at the shortest labeling time (1 min), DHA contained 31% of the label recovered in fatty acids, and this percentage remained essentially unchanged during the 10-15 min of [$^{14}$C]-acetate incorporation and the subsequent 24 hours of culture growth (See U.S. Patent Application Publication No. 20020194641, supra). Similarly, DPA represented 10% of the label throughout the experiment. There is no evidence for a precursor-product relationship between 16- or 18-carbon fatty acids and the 22-carbon polyunsaturated fatty acids. These results are consistent with rapid synthesis of DHA from [$^{14}$C]-acetate involving very small (possibly enzyme-bound) pools of intermediates.

FIG. 1 is a graphical representation of the three open reading frames from the Schizochytrium PUFA PKS system, and includes the domain structure of this PUFA PKS system. There are three open reading frames that form the core Schizochytrium PUFA PKS system. The domain structure of each open reading frame is as follows.

Schizochytrium Open Reading Frame A (OrfA):

The complete nucleotide sequence for OrfA is represented herein as SEQ ID NO:1. OrfA is a 8730 nucleotide sequence (not including the stop codon) which encodes a 2910 amino acid sequence, represented herein as SEQ ID NO:2. Within OrfA are twelve domains: (a) one β-keto acyl-ACP synthase (KS) domain; (b) one malonyl-CoA:ACP acyltransferase (MAT) domain; (c) nine acyl carrier protein (ACP) domains; and (d) one ketoreductase (KR) domain. Genomic DNA clones (plasmids) encoding OrfA from both Schizochytrium sp. ATCC 20888 and a daughter strain of ATCC 20888, denoted Schizochytrium sp., strain N230D, have been isolated and sequenced. N230D was one of more than 1,000 randomly-chosen survivors of chemically mutagenised (NTG; 1-methyl-3-nitro-1-nitrosoguanidine) Schizochytrium ATCC 20888 screened for variations in fatty acid content. This particular strain was valued for its improved DHA productivity.

A genomic clone described herein as JK1126, isolated from Schizochytrium sp. ATCC 20888, comprises, to the best of the present inventors' knowledge, the nucleotide sequence spanning from position 1 to 8730 of SEQ ID NO:1, and encodes the corresponding amino acid sequence of SEQ ID NO:2. Genomic clone pJK1126 (denoted pJK1126 OrfA genomic clone, in the form of an E. coli plasmid vector containing "OrfA" gene from Schizochytrium ATCC 20888) was deposited with the American Type Culture Collection (ATCC), 10801 University Boulevard, Manassas, Va. 20110-2209 USA on Jun. 8, 2006, and assigned ATCC Accession No. PTA-7648. The nucleotide sequence of pJK1126 OrfA genomic clone, and the amino acid sequence encoded by this plasmid are encompassed by the present invention.

Two genomic clones described herein as pJK306 OrfA genomic clone and pJK320 OrfA genomic clone, isolated from Schizochytrium sp. N230D, together (overlapping clones) comprise, to the best of the present inventors' knowledge, the nucleotide sequence of SEQ ID NO:1, and encode the amino acid sequence of SEQ ID NO:2. Genomic clone pJK306 (denoted pJK306 OrfA genomic clone, in the form of an E. coli plasmid containing 5' portion of OrfA gene from Schizochytrium sp. N230D (2.2 kB overlap with pJK320)) was deposited with the American Type Culture Collection (ATCC), 10801 University Boulevard, Manassas, Va. 20110-2209 USA on Jun. 8, 2006, and assigned ATCC Accession No. PTA-7641. The nucleotide sequence of pJK306 OrfA genomic clone, and the amino acid sequence encoded by this plasmid are encompassed by the present invention. Genomic clone pJK320 (denoted pJK320 OrfA genomic clone, in the form of an E. coli plasmid containing 3' portion of OrfA gene from Schizochytrium sp. N230D (2.2 kB overlap with pJK306)) was deposited with the American Type Culture Collection (ATCC), 10801 University Boulevard, Manassas, Va. 20110-2209 USA on Jun. 8, 2006, and assigned ATCC Accession No. PTA-7644. The nucleotide sequence of pJK320 OrfA genomic clone, and the amino acid sequence encoded by this plasmid are encompassed by the present invention.

The first domain in OrfA is a KS domain, also referred to herein as ORFA-KS, and the nucleotide sequence containing the sequence encoding the ORFA-KS domain is represented herein as SEQ ID NO:7 (positions 1-1500 of SEQ ID NO:1). The amino acid sequence containing the ORFA-KS domain is represented herein as SEQ ID NO:8 (positions 1-500 of SEQ ID NO:2). It is noted that the ORFA-KS domain contains an active site motif: DXAC* (*acyl binding site $C_{215}$). Also, a characteristic motif at the end of the Schizochytrium KS region, GFGG, is present in this domain in SEQ ID NO:2 and accordingly, in SEQ ID NO:8.

The second domain in OrfA is a MAT domain, also referred to herein as ORFA-MAT, and the nucleotide sequence containing the sequence encoding the ORFA-MAT domain is represented herein as SEQ ID NO:9 (positions 1723-3000 of SEQ ID NO:1). The amino acid sequence containing the ORFA-MAT domain is represented herein as SEQ ID NO:10 (positions 575-1000 of SEQ ID NO:2). The MAT domain comprises an aspartate at position 93 and a histidine at position 94 (corresponding to positions 667 and 668, respectively, of SEQ ID NO:2). It is noted that the ORFA-MAT domain contains an active site motif: GHS*XG (*acyl binding site $S_{706}$), represented herein as SEQ ID NO:11.

Domains 3-11 of OrfA are nine tandem ACP domains, also referred to herein as ORFA-ACP (the first domain in the sequence is ORFA-ACP1, the second domain is ORFA-ACP2, the third domain is ORFA-ACP3, etc.). The first ACP domain, ORFA-ACP1, is contained within the nucleotide sequence spanning from about position 3343 to about position 3600 of SEQ ID NO:1 (OrfA). The nucleotide sequence containing the sequence encoding the ORFA-ACP1 domain is represented herein as SEQ ID NO:12 (positions 3343-3600 of SEQ ID NO:1). The amino acid sequence containing the first ACP domain spans from about position 1115 to about position 1200 of SEQ ID NO:2. The amino acid sequence containing the ORFA-ACP1 domain is represented herein as SEQ ID NO:13 (positions 1115-1200 of SEQ ID NO:2). It is noted that the ORFA-ACP1 domain contains an active site motif: LGIDS* (*pantetheine binding motif $S_{1157}$), represented herein by SEQ ID NO:14.

The nucleotide and amino acid sequences of all nine ACP domains are highly conserved and therefore, the sequence for each domain is not represented herein by an individual sequence identifier. However, based on the information disclosed herein, one of skill in the art can readily determine the sequence containing each of the other eight ACP domains. All nine ACP domains together span a region of OrfA of from about position 3283 to about position 6288 of SEQ ID NO:1, which corresponds to amino acid positions of from about 1095 to about 2096 of SEQ ID NO:2. The nucleotide sequence for the entire ACP region containing all nine domains is represented herein as SEQ ID NO:16. The region represented by SEQ ID NO:16 includes the linker segments between individual ACP domains. The repeat interval for the nine domains is approximately every 330 nucleotides of SEQ ID NO:16 (the actual number of amino acids measured between adjacent active site serines ranges from 104 to 116 amino acids). Each of the nine ACP domains contains a pantetheine binding motif LGIDS* (represented herein by SEQ ID NO:14), wherein S* is the pantetheine binding site serine (S). The pantetheine binding site serine (S) is located near the center of each ACP domain sequence. At each end of the ACP domain region and between each ACP domain is a region that is highly enriched for proline (P) and alanine (A), which is believed to be a linker region. For example, between ACP domains 1 and 2 is the sequence: APAPVKAAA-PAAPVASAPAPA, represented herein as SEQ ID NO:15. The locations of the active site serine residues (i.e., the pantetheine binding site) for each of the nine ACP domains, with respect to the amino acid sequence of SEQ ID NO:2, are as follows: ACP1=$S_{1157}$; ACP2=$S_{1266}$; ACP3=$S_{1377}$; ACP4=$S_{1488}$; ACP5=$S_{1604}$; ACP6=$S_{1715}$; ACP7=$S_{1819}$; ACP8=$S_{1930}$; and ACP9=$S_{2034}$. Given that the average size of an ACP domain is about 85 amino acids, excluding the linker, and about 110 amino acids including the linker, with the active site serine being approximately in the center of the domain, one of skill in the art can readily determine the positions of each of the nine ACP domains in OrfA.

Domain 12 in OrfA is a KR domain, also referred to herein as ORFA-KR, and the nucleotide sequence containing the sequence encoding the ORFA-KR domain is represented herein as SEQ ID NO:17 (positions 6598-8730 of SEQ ID NO:1). The amino acid sequence containing the ORFA-KR domain is represented herein as SEQ ID NO:18 (positions 2200-2910 of SEQ ID NO:2). Within the KR domain is a core region with homology to short chain aldehyde-dehydrogenases (KR is a member of this family). This core region spans from about position 7198 to about position 7500 of SEQ ID NO:1, which corresponds to amino acid positions 2400-2500 of SEQ ID NO:2.

*Schizochytrium* Open Reading Frame B (OrfB):

The complete nucleotide sequence for OrfB is represented herein as SEQ ID NO:3. OrfB is a 6177 nucleotide sequence (not including the stop codon) which encodes a 2059 amino acid sequence, represented herein as SEQ ID NO:4. Within OrfB are four domains: (a) one -keto acyl-ACP synthase (KS) domain; (b) one chain length factor (CLF) domain; (c) one acyl transferase (AT) domain; and, (d) one enoyl ACP-reductase (ER) domain.

Genomic DNA clones (plasmids) encoding OrfB from both *Schizochytrium* sp. ATCC 20888 and a daughter strain of ATCC 20888, denoted *Schizochytrium* sp., strain N230D, have been isolated and sequenced.

A genomic clone described herein as pJK1129, isolated from *Schizochytrium* sp. ATCC 20888, comprises, to the best of the present inventors' knowledge, the nucleotide sequence of SEQ ID NO:3, and encodes the amino acid sequence of SEQ ID NO:4. Genomic clone pJK1129 (denoted pJK1129 OrfB genomic clone, in the form of an *E. coli* plasmid vector containing "OrfB" gene from *Schizochytrium* ATCC 20888) was deposited with the American Type Culture Collection (ATCC), 10801 University Boulevard, Manassas, Va. 20110-2209 USA on Jun. 8, 2006, and assigned ATCC Accession No. PTA-7649. The nucleotide sequence of pJK1126 OrfB genomic clone, and the amino acid sequence encoded by this plasmid are encompassed by the present invention.

A genomic clone described herein as pJK324 OrfB genomic clone, isolated from *Schizochytrium* sp. N230D, comprises, to the best of the present inventors' knowledge, the nucleotide sequence of SEQ ID NO:3, and encodes the amino acid sequence of SEQ ID NO:4. Genomic clone pJK324 (denoted pJK324 OrfB genomic clone, in the form of an *E. coli* plasmid containing the OrfB gene sequence from *Schizochytrium* sp. N230D) was deposited with the American Type Culture Collection (ATCC), 10801 University Boulevard, Manassas, Va. 20110-2209 USA on Jun. 8, 2006, and assigned ATCC Accession No. PTA-7643. The nucleotide sequence of pJK324 OrfB genomic clone, and the amino acid sequence encoded by this plasmid are encompassed by the present invention.

The first domain in OrfB is a KS domain, also referred to herein as ORFB-KS, and the nucleotide sequence containing the sequence encoding the ORFB-KS domain is represented herein as SEQ ID NO:19 (positions 1-1350 of SEQ ID NO:3). The amino acid sequence containing the ORFB-KS domain is represented herein as SEQ ID NO:20 (positions 1-450 of SEQ ID NO:4). This KS domain comprises a valine at position 371 of SEQ ID NO:20 (also position 371 of SEQ ID NO:20). It is noted that the ORFB-KS domain contains an active site motif: DXAC* (*acyl binding site $C_{196}$). Also, a characteristic motif at the end of this KS region, GFGG, is present in this domain in SEQ ID NO:4 and accordingly, in SEQ ID NO:20.

The second domain in OrfB is a CLF domain, also referred to herein as ORFB-CLF, and the nucleotide sequence containing the sequence encoding the ORFB-CLF domain is represented herein as SEQ ID NO:21 (positions 1378-2700 of SEQ ID NO:3). The amino acid sequence containing the ORFB-CLF domain is represented herein as SEQ ID NO:22

(positions 460-900 of SEQ ID NO:4). It is noted that the ORFB-CLF domain contains a KS active site motif without the acyl-binding cysteine.

The third domain in OrfB is an AT domain, also referred to herein as ORFB-AT, and the nucleotide sequence containing the sequence encoding the ORFB-AT domain is represented herein as SEQ ID NO:23 (positions 2701-4200 of SEQ ID NO:3). The amino acid sequence containing the ORFB-AT domain is represented herein as SEQ ID NO:24 (positions 901-1400 of SEQ ID NO:4). It is noted that the ORFB-AT domain contains an active site motif of GxS*xG (*acyl binding site $S_{1140}$) that is characteristic of acyltransferse (AT) proteins.

The fourth domain in OrfB is an ER domain, also referred to herein as ORFB-ER, and the nucleotide sequence containing the sequence encoding the ORFB-ER domain is represented herein as SEQ ID NO:25 (positions 4648-6177 of SEQ ID NO:3). The amino acid sequence containing the ORFB-ER domain is represented herein as SEQ ID NO:26 (positions 1550-2059 of SEQ ID NO:4).

*Schizochytrium* Open Reading Frame C (OrfC):

The complete nucleotide sequence for OrfC is represented herein as SEQ ID NO:5. OrfC is a 4506 nucleotide sequence (not including the stop codon) which encodes a 1502 amino acid sequence, represented herein as SEQ ID NO:6. Within OrfC are three domains: (a) two FabA-like-hydroxy acyl-ACP dehydrase (DH) domains; and (b) one enoyl ACP-reductase (ER) domain.

Genomic DNA clones (plasmids) encoding OrfC from both *Schizochytrium* sp. ATCC 20888 and a daughter strain of ATCC 20888, denoted *Schizochytrium* sp., strain N230D, have been isolated and sequenced.

A genomic clone described herein as pJK1131, isolated from *Schizochytrium* sp. ATCC 20888, comprises, to the best of the present inventors' knowledge, the nucleotide sequence of SEQ ID NO:5, and encodes the amino acid sequence of SEQ ID NO:6. Genomic clone pJK1131 (denoted pJK1131 OrfC genomic clone, in the form of an *E. coli* plasmid vector containing "OrfC" gene from *Schizochytrium* ATCC 20888) was deposited with the American Type Culture Collection (ATCC), 10801 University Boulevard, Manassas, Va. 20110-2209 USA on Jun. 8, 2006, and assigned ATCC Accession No. PTA-7650. The nucleotide sequence of pJK1131 OrfC genomic clone, and the amino acid sequence encoded by this plasmid are encompassed by the present invention.

A genomic clone described herein as pBR002 OrfC genomic clone, isolated from *Schizochytrium* sp. N230D, comprises, to the best of the present inventors' knowledge, the nucleotide sequence of SEQ ID NO:5, and encodes the amino acid sequence of SEQ ID NO:6. Genomic clone pBR002 (denoted pBR002 OrfC genomic clone, in the form of an *E. coli* plasmid vector containing the OrfC gene sequence from *Schizochytrium* sp. N230D) was deposited with the American Type Culture Collection (ATCC), 10801 University Boulevard, Manassas, Va. 20110-2209 USA on Jun. 8, 2006, and assigned ATCC Accession No. PTA-7642. The nucleotide sequence of pBR002 OrfC genomic clone, and the amino acid sequence encoded by this plasmid are encompassed by the present invention.

The first domain in OrfC is a DH domain, also referred to herein as ORFC-DH1. This is one of two DH domains in OrfC, and therefore is designated DH1. The nucleotide sequence containing the sequence encoding the ORFC-DH1 domain is represented herein as SEQ ID NO:27 (positions 1-1350 of SEQ ID NO:5). The amino acid sequence containing the ORFC-DH1 domain is represented herein as SEQ ID NO:28 (positions 1-450 of SEQ ID NO:6).

The second domain in OrfC is a DH domain, also referred to herein as ORFC-DH2. This is the second of two DH domains in OrfC, and therefore is designated DH2. The nucleotide sequence containing the sequence encoding the ORFC-DH2 domain is represented herein as SEQ ID NO:29 (positions 1351-2847 of SEQ ID NO:5). The amino acid sequence containing the ORFC-DH2 domain is represented herein as SEQ ID NO:30 (positions 451-949 of SEQ ID NO:6). This DH domain comprises the amino acids H-G-I-A-N-P-T-F-V-H-A-P-G-K-I (positions 876-890 of SEQ ID NO:6) at positions 426-440 of SEQ ID NO:30.

The third domain in OrfC is an ER domain, also referred to herein as ORFC-ER, and the nucleotide sequence containing the sequence encoding the ORFC-ER domain is represented herein as SEQ ID NO:31 (positions 2995-4506 of SEQ ID NO:5). The amino acid sequence containing the ORFC-ER domain is represented herein as SEQ ID NO:32 (positions 999-1502 of SEQ ID NO:6).

*Thraustochytrium* PUFA PKS System

There are three open reading frames that form the core *Thraustochytrium* 23B PUFA PKS system. The domain organization is the same as that of *Schizochytrium* with the exception that the Th. 23B Orf A has 8 adjacent ACP domains, while *Schizochytrium* OrfA has 9 adjacent ACP domains. The domain structure of each open reading frame is as follows.

*Thraustochytrium* 23B Open Reading Frame A (OrfA):

The complete nucleotide sequence for Th. 23B OrfA is represented herein as SEQ ID NO:38. Th. 23B OrfA is a 8433 nucleotide sequence (not including the stop codon) which encodes a 2811 amino acid sequence, represented herein as SEQ ID NO:39. SEQ ID NO:38 encodes the following domains in Th. 23B OrfA: (a) one β-ketoacyl-ACP synthase (KS) domain; (b) one malonyl-CoA:ACP acyltransferase (MAT) domain; (c) eight acyl carrier protein (ACP) domains; and (d) one β-ketoacyl-ACP reductase (KR) domain.

Two genomic clones described herein as Th23BOrfA_pBR812.1 and Th23BOrfA_pBR811 (OrfA genomic clones), isolated from *Thraustochytrium* 23B, together (overlapping clones) comprise, to the best of the present inventors' knowledge, the nucleotide sequence of SEQ ID NO:38, and encodes the amino acid sequence of SEQ ID NO:39. Genomic clone Th23BOrfA_pBR812.1 (denoted Th23BOrfA_pBR812.1 genomic clone, in the form of an *E. coli* plasmid vector containing the OrfA gene sequence from *Thraustochytrium* 23B) was deposited with the American Type Culture Collection (ATCC), 10801 University Boulevard, Manassas, Va. 20110-2209 USA on Mar. 1, 2007, and assigned ATCC Accession No. PTA-8232. The nucleotide sequence of Th23BOrfA_pBR812.1, an OrfA genomic clone, and the amino acid sequence encoded by this plasmid are encompassed by the present invention. Genomic clone Th23BOrfA_pBR811 (denoted Th23BOrfA_pBR811 genomic clone, in the form of an *E. coli* plasmid vector containing the OrfA gene sequence from *Thraustochytrium* 23B) was deposited with the American Type Culture Collection (ATCC), 10801 University Boulevard, Manassas, Va. 20110-2209 USA on Mar. 1, 2007, and assigned ATCC Accession No. PTA-8231. The nucleotide sequence of Th23BOrfA_pBR811, an OrfA genomic clone, and the amino acid sequence encoded by this plasmid are encompassed by the present invention.

The first domain in Th. 23B OrfA is a KS domain, also referred to herein as Th. 23B OrfA-KS, and is contained within the nucleotide sequence spanning from about position 1 to about position 1500 of SEQ ID NO:38, represented herein as SEQ ID NO:40. The amino acid sequence containing the Th. 23B KS domain is a region of SEQ ID NO:39 spanning from about position 1 to about position 500 of SEQ ID NO:39, represented herein as SEQ ID NO:41. This region of SEQ ID NO:39 has a Pfam match to FabB (β-ketoacyl-ACP synthase) spanning from position 1 to about position 450 of SEQ ID NO:39 (also positions 1 to about 450 of SEQ ID NO:41). It is noted that the Th. 23B OrfA-KS domain contains an active site motif: DXAC* (*acyl binding site $C_{207}$). Also, a characteristic motif at the end of the Th. 23B KS region, GFGG, is present in positions 453-456 of SEQ ID NO:39 (also positions 453-456 of SEQ ID NO:41).

The second domain in Th. 23B OrfA is a MAT domain, also referred to herein as Th. 23B OrfA-MAT, and is contained within the nucleotide sequence spanning from between about position 1503 and about position 3000 of SEQ ID NO:38, represented herein as SEQ ID NO:42. The amino acid sequence containing the Th. 23B MAT domain is a region of SEQ ID NO:39 spanning from about position 501 to about position 1000, represented herein by SEQ ID NO:43. This region of SEQ ID NO:39 has a Pfam match to FabD (malonyl-CoA:ACP acyltransferase) spanning from about position 580 to about position 900 of SEQ ID NO:39 (positions 80-400 of SEQ ID NO:43). It is noted that the Th. 23B OrfA-MAT domain contains an active site motif: GHS*XG (*acyl binding site $S_{697}$), represented by positions 695-699 of SEQ ID NO:39.

Domains 3-10 of Th. 23B OrfA are eight tandem ACP domains, also referred to herein as Th. 23B OrfA-ACP (the first domain in the sequence is OrfA-ACP1, the second domain is OrfA-ACP2, the third domain is OrfA-ACP3, etc.). The first Th. 23B ACP domain, Th. 23B OrfA-ACP1, is contained within the nucleotide sequence spanning from about position 3205 to about position 3555 of SEQ ID NO:38 (OrfA), represented herein as SEQ ID NO:44. The amino acid sequence containing the first Th. 23B ACP domain is a region of SEQ ID NO:39 spanning from about position 1069 to about position 1185 of SEQ ID NO:39, represented herein by SEQ ID NO:45.

The eight ACP domains in Th. 23B OrfA are adjacent to one another and can be identified by the presence of the phosphopantetheine binding site motif, LGXDS* (represented by SEQ ID NO:46), wherein the S* is the phosphopantetheine attachment site. The amino acid position of each of the eight S* sites, with reference to SEQ ID NO:39, are 1128 (ACP1), 1244 (ACP2), 1360 (ACP3), 1476 (ACP4), 1592 (ACP5), 1708 (ACP6), 1824 (ACP7) and 1940 (ACP8). The nucleotide and amino acid sequences of all eight Th. 23B ACP domains are highly conserved and therefore, the sequence for each domain is not represented herein by an individual sequence identifier. However, based on the information disclosed herein, one of skill in the art can readily determine the sequence containing each of the other seven ACP domains in SEQ ID NO:38 and SEQ ID NO:39.

All eight Th. 23B ACP domains together span a region of Th. 23B OrfA of from about position 3205 to about position 5994 of SEQ ID NO:38, which corresponds to amino acid positions of from about 1069 to about 1998 of SEQ ID NO:39. The nucleotide sequence for the entire ACP region containing all eight domains is represented herein as SEQ ID NO:47. SEQ ID NO:47 encodes an amino acid sequence represented herein by SEQ ID NO:48. SEQ ID NO:48 includes the linker segments between individual ACP domains. The repeat interval for the eight domains is approximately every 116 amino acids of SEQ ID NO:48, and each domain can be considered to consist of about 116 amino acids centered on the active site motif (described above).

The last domain in Th. 23B OrfA is a KR domain, also referred to herein as Th. 23B OrfA-KR, which is contained within the nucleotide sequence spanning from between about position 6001 to about position 8433 of SEQ ID NO:38, represented herein by SEQ ID NO:49. The amino acid sequence containing the Th. 23B KR domain is a region of SEQ ID NO:39 spanning from about position 2001 to about position 2811 of SEQ ID NO:39, represented herein by SEQ ID NO:50. This region of SEQ ID NO:39 has a Pfam match to FabG (β-ketoacyl-ACP reductase) spanning from about position 2300 to about 2550 of SEQ ID NO:39 (positions 300-550 of SEQ ID NO:50).

*Thraustochytrium.* 23B Open Reading Frame B (OrfB):

The complete nucleotide sequence for Th. 23B OrfB is represented herein as SEQ ID NO:51, which is a 5805 nucleotide sequence (not including the stop codon) that encodes a 1935 amino acid sequence, represented herein as SEQ ID NO:52. SEQ ID NO:51 encodes the following domains in Th. 23B OrfB: (a) one β-ketoacyl-ACP synthase (KS) domain; (b) one chain length factor (CLF) domain; (c) one acyltransferase (AT) domain; and, (d) one enoyl-ACP reductase (ER) domain.

A genomic clone described herein as Th23BOrfB_pBR800 (OrfB genomic clone), isolated from *Thraustochytrium* 23B, comprises, to the best of the present inventors' knowledge, the nucleotide sequence of SEQ ID NO:51, and encodes the amino acid sequence of SEQ ID NO:52. Genomic clone Th23BOrfB_pBR800 (denoted Th23BOrfB_pBR800 genomic clone, in the form of an *E. coli* plasmid vector containing the OrfB gene sequence from *Thraustochytrium* 23B) was deposited with the American Type Culture Collection (ATCC), 10801 University Boulevard, Manassas, Va. 20110-2209 USA on Mar. 1, 2007, and assigned ATCC Accession No. PTA-8227. The nucleotide sequence of Th23BOrfB_pBR800, an OrfB genomic clone, and the amino acid sequence encoded by this plasmid are encompassed by the present invention.

The first domain in the Th. 23B OrfB is a KS domain, also referred to herein as Th. 23B OrfB-KS, which is contained within the nucleotide sequence spanning from between about position 1 and about position 1500 of SEQ ID NO:51 (Th. 23B OrfB), represented herein as SEQ ID NO:53. The amino acid sequence containing the Th. 23B KS domain is a region of SEQ ID NO: 52 spanning from about position 1 to about position 500 of SEQ ID NO:52, represented herein as SEQ ID NO:54. This region of SEQ ID NO:52 has a Pfam match to FabB (β-ketoacyl-ACP synthase) spanning from about position 1 to about position 450 (positions 1-450 of SEQ ID NO:54). It is noted that the Th. 23B OrfB-KS domain contains an active site motif: DXAC*, where C* is the site of acyl group attachment and wherein the C* is at position 201 of SEQ ID NO:52. Also, a characteristic motif at the end of the KS region, GFGG is present in amino acid positions 434-437 of SEQ ID NO:52.

The second domain in Th. 23B OrfB is a CLF domain, also referred to herein as Th. 23B OrfB-CLF, which is contained within the nucleotide sequence spanning from between about position 1501 and about position 3000 of SEQ ID NO:51 (OrfB), represented herein as SEQ ID NO:55. The amino acid sequence containing the CLF domain is a region of SEQ ID NO: 52 spanning from about position 501 to about position 1000 of SEQ ID NO:52, represented herein as SEQ ID NO:56. This region of SEQ ID NO:52 has a Pfam match to FabB (β-ketoacyl-ACP synthase) spanning from about position 550 to about position 910 (positions 50-410 of SEQ ID NO:56). Although CLF has homology to KS proteins, it lacks an active site cysteine to which the acyl group is attached in KS proteins.

The third domain in Th. 23B OrfB is an AT domain, also referred to herein as Th. 23B OrfB-AT, which is contained within the nucleotide sequence spanning from between about position 3001 and about position 4500 of SEQ ID NO:51 (Th. 23B OrfB), represented herein as SEQ ID NO:58. The amino acid sequence containing the Th. 23B AT domain is a region of SEQ ID NO: 52 spanning from about position 1001 to about position 1500 of SEQ ID NO:52, represented herein as SEQ ID NO:58. This region of SEQ ID NO:52 has a Pfam match to FabD (malonyl-CoA:ACP acyltransferase) spanning from about position 1100 to about position 1375 (positions 100-375 of SEQ ID NO:58). Although this AT domain of the PUFA synthases has homology to MAT proteins, it lacks the extended motif of the MAT (key arginine and glutamine residues) and it is not thought to be involved in malonyl-CoA transfers. The GXS*XG motif of acyltransferases is present, with the S* being the site of acyl attachment and located at position 1123 with respect to SEQ ID NO:52.

The fourth domain in Th. 23B OrfB is an ER domain, also referred to herein as Th. 23B OrfB-ER, which is contained within the nucleotide sequence spanning from between about position 4501 and about position 5805 of SEQ ID NO:51 (OrfB), represented herein as SEQ ID NO:59. The amino acid sequence containing the Th. 23B ER domain is a region of SEQ ID NO: 52 spanning from about position 1501 to about position 1935 of SEQ ID NO:52, represented herein as SEQ ID NO:60. This region of SEQ ID NO:52 has a Pfam match to a family of dioxygenases related to 2-nitropropane dioxygenases spanning from about position 1501 to about position 1810 (positions 1-310 of SEQ ID NO:60). That this domain functions as an ER can be further predicted due to homology to a newly characterized ER enzyme from *Streptococcus pneumoniae*.

*Thraustochytrium*. 23B Open Reading Frame C (OrfC):

The complete nucleotide sequence for Th. 23B OrfC is represented herein as SEQ ID NO:61, which is a 4410 nucleotide sequence (not including the stop codon) that encodes a 1470 amino acid sequence, represented herein as SEQ ID NO:62. SEQ ID NO:61 encodes the following domains in Th. 23B OrfC: (a) two FabA-like β-hydroxyacyl-ACP dehydrase (DH) domains, both with homology to the FabA protein (an enzyme that catalyzes the synthesis of trans-2-decenoyl-ACP and the reversible isomerization of this product to cis-3-decenoyl-ACP); and (b) one enoyl-ACP reductase (ER) domain with high homology to the ER domain of *Schizochytrium* OrfB.

A genomic clone described herein as Th23BOrfC_pBR709A (OrfC genomic clone), isolated from *Thraustochytrium* 23B, comprises, to the best of the present inventors' knowledge, the nucleotide sequence of SEQ ID NO:61, and encodes the amino acid sequence of SEQ ID NO:62. Genomic clone Th23BOrfC_pBR709A (denoted Th23BOrfC_pBR709A genomic clone, in the form of an *E. coli* plasmid vector containing the OrfC gene sequence from *Thraustochytrium* 23B) was deposited with the American Type Culture Collection (ATCC), 10801 University Boulevard, Manassas, Va. 20110-2209 USA on Mar. 1, 2007, and assigned ATCC Accession No. PTA-8228. The nucleotide sequence of Th23BOrfC_pBR709A, an OrfC genomic clone, and the amino acid sequence encoded by this plasmid are encompassed by the present invention.

The first domain in Th. 23B OrfC is a DH domain, also referred to herein as Th. 23B OrfC-DH1, which is contained within the nucleotide sequence spanning from between about position 1 to about position 1500 of SEQ ID NO:61 (OrfC), represented herein as SEQ ID NO:63. The amino acid sequence containing the Th. 23B DH1 domain is a region of SEQ ID NO: 62 spanning from about position 1 to about position 500 of SEQ ID NO:62, represented herein as SEQ ID NO:64. This region of SEQ ID NO:62 has a Pfam match to FabA, as mentioned above, spanning from about position 275 to about position 400 (positions 275-400 of SEQ ID NO:64).

The second domain in Th. 23B OrfC is also a DH domain, also referred to herein as Th. 23B OrfC-DH2, which is contained within the nucleotide sequence spanning from between about position 1501 to about 3000 of SEQ ID NO:61 (OrfC), represented herein as SEQ ID NO:65. The amino acid sequence containing the Th. 23B DH2 domain is a region of SEQ ID NO: 62 spanning from about position 501 to about position 1000 of SEQ ID NO:62, represented herein as SEQ ID NO:66. This region of SEQ ID NO:62 has a Pfam match to FabA, as mentioned above, spanning from about position 800 to about position 925 (positions 300-425 of SEQ ID NO:66).

The third domain in Th. 23B OrfC is an ER domain, also referred to herein as Th. 23B OrfC-ER, which is contained within the nucleotide sequence spanning from between about position 3001 to about position 4410 of SEQ ID NO:61 (OrfC), represented herein as SEQ ID NO:67. The amino acid sequence containing the Th. 23B ER domain is a region of SEQ ID NO: 62 spanning from about position 1001 to about position 1470 of SEQ ID NO:62, represented herein as SEQ ID NO:68. This region of SEQ ID NO:62 has a Pfam match to the dioxygenases related to 2-nitropropane dioxygenases, as mentioned above, spanning from about position 1025 to about position 1320 (positions 25-320 of SEQ ID NO:68). This domain function as an ER can also be predicted due to homology to a newly characterized ER enzyme from *Streptococcus pneumoniae*.

Synthetic, Codon-Optimized Constructs

The invention also encompasses resynthesized versions of any of the nucleic acid sequences described herein, primarily having optimized codon usage for a heterologous organism (heterologous host), wherein the encoded amino acid sequence is not changed with reference to the natural, wild-type, or source amino acid sequence. The present inventors have discovered that resynthesizing nucleic acid sequences for optimal codon usage is an effective way to improve PUFA production in a heterologous host that is transformed with nucleic acid molecules from a PUFA PKS system. Resynthesis of all nucleic acid molecules in a PUFA PKS system is not necessarily required for optimal expression and PUFA production in a heterologous host. Indeed, the inventors have found that resynthesis of only some of the nucleic acid molecules is sufficient to improve PUFA production. For example, while resynthesis of *Schizochytrium* Orfs A and B improved PUFA synthase expression and PUFA production in yeast, use of the native *Schizochytrium* OrfC and native *Nostoc* HetI PPTase were sufficient. Moreover, codon optimization of a construct for use in one heterologous host may also be useful for improving the PUFA production in a different heterologous host (e.g., optimization of codon usage of an OrfC-encoding sequence from *Thraustochytrium* for use in *Schizochytrium* may also be effective for boosting PUFA production in another heterologous host organism, such as plants).

In addition, the use of synthetic, codon-optimized constructs can be useful in the production of chimeric PUFA PKS constructs and/or chimeric PUFA PKS systems, where a domain or protein from one PUFA PKS system (e.g., from a first organism) is introduced into a second PUFA PKS system (e.g., from a second organism). In such systems, not only can the PUFA profile be manipulated (e.g., by the use of the chimeric constructs and/or chimeric PUFA PKS systems), but the PUFA production can also be improved by the use of synthetic, codon-optimized chimeric constructs. Indeed, the combination of the two concepts (chimeras and codon optimization) may produce a synergistic result with respect to PUFA profiles and/or PUFA production. Chimeric systems containing some sequences that are codon-optimized for the host and some that are not codon-optimized for the host are included in the invention.

Certain codon-optimized sequences are described below by way of example. Other codon-optimized sequences will be apparent to those of skill in the art following this description.
sOrfA SEQ ID NO:35, denoted sOrfA, represents the nucleic acid sequence encoding OrfA from *Schizochytrium* (SEQ ID NO:1) that has been resynthesized for optimized codon usage in yeast. SEQ ID NO:1 and SEQ ID NO:35 each encode SEQ ID NO:2.
sOrfB SEQ ID NO:36, denoted sOrfB, represents the nucleic acid sequence encoding OrfB from *Schizochytrium* (SEQ ID NO:3) that has been resynthesized for optimized codon usage in yeast. SEQ ID NO:3 and SEQ ID NO:36 each encode SEQ ID NO:4.
OrfB*

SEQ ID NO:37, denoted OrfB* (pJK962), represents a nucleic acid sequence encoding OrfB from *Schizochytrium* (SEQ ID NO:4) that has been resynthesized within a portion of SEQ ID NO:3 (nucleotide sequence encoding SEQ ID NO:4) for use in plant cells, and that was derived from a very similar sequence initially developed for optimized codon usage in *E. coli*, also referred to as OrfB* (pJK780), which is described below. OrfB* in both forms (for *E. coli* and for plants) is identical to SEQ ID NO:3 with the exception of a resynthesized BspHI (nucleotide 4415 of SEQ ID NO:3) to a SacII fragment (unique site in SEQ ID NO:3). Both versions (*E. coli* and plant) have two other codon modifications near the start of the gene as compared with the original genomic sequence of orfB (SEQ ID NO:3). First, the fourth codon, arginine (R), was changed from CGG in the genomic sequence to CGC in orfB*. Second, the fifth codon, asparagine (N), was changed from AAT in the genomic sequence to AAC in orf B*. In order to facilitate cloning of this gene into the plant vectors to create SEQ ID NO:37, a PstI site (CTG-CAG) was also engineered into the *E. coli* orfB* sequence 20 bases from the start of the gene. This change did not alter the amino acid sequence of the encoded protein. Both SEQ ID NO:37 and SEQ ID NO:3 (as well as the OrfB* form for *E. coli*, described in SEQ ID NO:69 below) encode SEQ ID NO:4.

SEQ ID NO:69, denoted OrfB* (pJK780), represents a nucleic acid sequence encoding OrfB from *Schizochytrium* (SEQ ID NO:4) that has been resynthesized within a portion of SEQ ID NO:3 (nucleotide sequence encoding SEQ ID NO:4) for use in *E. coli*. The sequence of the OrfB* construct in both forms (for *E. coli* and for plants) has been described above. SEQ ID NO:69 and SEQ ID NO:3 encode SEQ ID NO:4.

The plasmid described herein as OrfB*_pJK780 comprises, to the best of the present inventors' knowledge, the nucleotide sequence of SEQ ID NO:69, and encodes the amino acid sequence of SEQ ID NO:4. Plasmid OrfB*_pJK780 (denoted OrfB*_pJK780 clone, in the form of an *E. coli* plasmid vector) was deposited with the American Type Culture Collection (ATCC), 10801 University Boulevard, Manassas, Va. 20110-2209 USA on Mar. 1, 2007, and assigned ATCC Accession No. PTA-8225. The nucleotide sequence of OrfB*_pJK780 and the amino acid sequence encoded by this plasmid are encompassed by the present invention.
pThOrfC-synPS SEQ ID NO:70 represents a nucleic acid sequence encoding a *Thraustochytrium* 23B OrfC (SEQ ID NO:61, encoding SEQ ID NO:62) that has been resynthesized for optimized codon usage in *Schizochytrium*. Positions 2000-6412 of SEQ ID NO:70 represents the coding region for the *Thraustochytrium* 23B OrfC protein (including stop codon). Positions 1-1999 and 6413-8394 of SEQ ID NO:70 represent upstream and downstream *Schizochytrium* OrfC sequences (non-coding regions), respectively. The construction of the plasmid containing SEQ ID NO:70, denoted pThOrfC-synPS, is described in detail in Example 1. SEQ ID NO:70 and SEQ ID NO:61 each encode SEQ ID NO:62. pThOrfC-syn PS is designed to exactly replace the coding region (CDS) of *Schizochytrium* orfC (SEQ ID NO; 5) with the coding region for the *Thraustochytrium* 23B orfC, resynthesized as discussed above (SEQ ID NO:70). The production and use of organisms that have been transformed with this construct are described in detail below and in the Examples.

The plasmid described above as pThOrfC-synPS comprises, to the best of the present inventors' knowledge, the nucleotide sequence of SEQ ID NO:70, and encodes the corresponding amino acid sequence of SEQ ID NO:62. Plasmid pThOrfC-synPS (denoted pThOrfC-synPS, in the form of an *E. coli* plasmid vector containing a "perfect stitch" synthetic *Thraustochytrium* 23B PUFA PKS OrfC codon optimized for expression in *Schizochytrium* or other heterologous hosts) was deposited with the American Type Culture Collection (ATCC), 10801 University Boulevard, Manassas, Va. 20110-2209 USA on Mar. 1, 2007, and assigned ATCC Accession No. PTA-8229. The nucleotide sequence of pThOrfC-synPS, and the amino acid sequence encoded by this plasmid are encompassed by the present invention.
pDD26

SEQ ID NO:71 represents a nucleic acid sequence encoding a *Thraustochytrium* 23B OrfA (SEQ ID NO:38, encoding SEQ ID NO:39) that has been resynthesized for optimized codon usage in *Schizochytrium*. Positions 2044-10479 of SEQ ID NO:71 represents the coding region for the *Thraustochytrium* 23B OrfA protein (including stop codon). Positions 1-2043 and 10480-12495 of SEQ ID NO:71 represent upstream and downstream *Schizochytrium* OrfA sequences (non-coding regions), respectively. The construction of the plasmid containing SEQ ID NO:71, denoted pDD26, is described in detail in Example 8. SEQ ID NO:71 and SEQ ID NO:38 each encode SEQ ID NO:39. pDD26 is designed to exactly replace the coding region (CDS) of *Schizochytrium* orfA (SEQ ID NO:1) with the coding region for the *Thraustochytrium* 23B orfC, resynthesized as discussed above (SEQ ID NO:71). The production and use of organisms that have been transformed with this construct are described in detail below and in the Examples.

The plasmid described above as pDD26 comprises, to the best of the present inventors' knowledge, the nucleotide sequence of SEQ ID NO:71, and encodes the corresponding amino acid sequence of SEQ ID NO:39. Plasmid pDD26 (denoted pDD26, in the form of an *E. coli* plasmid vector) was deposited with the American Type Culture Collection (ATCC), 10801 University Boulevard, Manassas, Va. 20110-2209 USA on May 8, 2007, and assigned ATCC Accession No. PTA-8411. The nucleotide sequence of pDD26, and the amino acid sequence encoded by this plasmid are encompassed by the present invention.

pDD32

SEQ ID NO:72 represents a nucleic acid sequence encoding a *Thraustochytrium* 23B OrfB (SEQ ID NO:51, encoding SEQ ID NO:52) that has been resynthesized for optimized codon usage in *Schizochytrium*. Positions 1452-7259 of SEQ ID NO:72 represent the coding region for the *Thraustochytrium* 23B OrfB protein (including stop codon). Positions 1-1451 and 7260-8647 of SEQ ID NO:72 represent upstream and downstream *Schizochytrium* OrfB sequences (non-coding regions), respectively. The construction of the plasmid containing SEQ ID NO:72, denoted pDD32, is described in detail in Example 8. SEQ ID NO:72 and SEQ ID NO:51 each encode SEQ ID NO:52. pDD32 is designed to exactly replace the coding region (CDS) of *Schizochytrium* orfB (SEQ ID NO:3) with the coding region for the *Thraustochytrium* 23B orfC, resynthesized as discussed above (SEQ ID NO:72). The production and use of organisms that have been transformed with this construct are described in detail below and in the Examples.

The plasmid described above as pDD32 comprises, to the best of the present inventors' knowledge, the nucleotide sequence of SEQ ID NO:72, and encodes the corresponding amino acid sequence of SEQ ID NO:52. Plasmid pDD32 (denoted pDD32, in the form of an *E. coli* plasmid vector) was deposited with the American Type Culture Collection (ATCC), 10801 University Boulevard, Manassas, Va. 20110-2209 USA on May 8, 2007, and assigned ATCC Accession No. PTA-8412. The nucleotide sequence of pDD32, and the amino acid sequence encoded by this plasmid are encompassed by the present invention.

Chimeric PUFA PKS Constructs

The invention also encompasses chimeric constructs using portions of two or more different PUFA PKS nucleic acid sequences, such as those described herein, to produce chimeric PUFA PKS proteins. The present inventors demonstrate herein in several different examples that by "mixing and matching" domains or portions of PUFA PKS proteins from different organisms (i.e., creating chimeric PUFA PKS proteins comprised of domains or polypeptides from two or more different organisms), the profile of the PUFAs produced by an organism expressing a PUFA PKS system containing such chimeric proteins can be modified, as compared to a native (naturally occurring) PUFA PKS system. For example, the present inventors describe herein the use of the DH2 domain from a *Thraustochytrium* PUFA PKS system in the OrfC protein of a *Schizochytrium* protein, so that the resulting chimeric OrfC protein contains the DH1 and ER domains from *Schizochytrium*, and the DH2 domain from *Thraustochytrium*. The chimeric construct is further modified by the use of a codon-optimized (for *Schizochytrium*) *Thraustochytrium* DH2 domain in one construct, and a native *Thraustochytrium* DH2 domain in another construct, which demonstrates the flexibility and effects of the various modifications described herein.

Certain chimeric constructs are described below by way of example. Other chimeric constructs will be apparent to those of skill in the art following this description.

pDS49

SEQ ID NO:73 represents a nucleic acid sequence encoding a chimeric protein comprising a *Schizochytrium* OrfC protein (SEQ ID NO:6) in which the DH2 domain (SEQ ID NO:30) has been replaced with the DH2 domain (sequence including SEQ ID NO:66) from *Thraustochytrium* 23B OrfC (SEQ ID NO:62). In this chimeric construct, the DH2-encoding sequence from *Thraustochytrium* is the native (non-codon-optimized) sequence. The construction of the plasmid containing SEQ ID NO:73, denoted pDS49, is described in detail in Example 2. The *Schizochytrium* OrfC upstream and downstream non-coding sequences that flank SEQ ID NO:73 in pDS49 are the same as those described above with respect to SEQ ID NO:70 (not represented in SEQ ID NO:73). SEQ ID NO:73 encodes an amino acid sequence of SEQ ID NO:74. Referring to SEQ ID NO:74, the chimeric OrfC polypeptide is 1493 amino acid residues in length. The DH2 region, defined as amino acids 516-1041 of SEQ ID NO:74, consists of the amino acid sequence of the DH2 region of the Th.23B OrfC protein, that is, amino acids 491-1016 of SEQ ID NO:62, which includes all of SEQ ID NO:66 and some flanking amino acid sequence from SEQ ID NO:62. With respect to the remainder of the chimeric OrfC amino acid sequence, residues 1-515 and 1042-1493 of SEQ ID NO:74 are identical to *Schizochytrium* OrfC residues 1-515 and 1051-1502 of SEQ ID NO:6, respectively. The production and use of organisms that have been transformed with this construct are described in detail below and in the Examples.

The plasmid described above as pDS49 comprises, to the best of the present inventors' knowledge, the nucleotide sequence of SEQ ID NO:73, and encodes the corresponding amino acid sequence of SEQ ID NO:74. Plasmid pDS49 (denoted pDS49, in the form of an *E. coli* plasmid vector) was deposited with the American Type Culture Collection (ATCC), 10801 University Boulevard, Manassas, Va. 20110-2209 USA on Mar. 1, 2007, and assigned ATCC Accession No. PTA-8230. The nucleotide sequence of pDS49, and the amino acid sequence encoded by this plasmid are encompassed by the present invention.

pDD24

SEQ ID NO:75 represents another nucleic acid sequence encoding a chimeric protein comprising a *Schizochytrium* OrfC protein (SEQ ID NO:6) in which the DH2 domain (SEQ ID NO:30) has been replaced with the DH2 domain (sequence including SEQ ID NO:66) from *Thraustochytrium* 23B OrfC (SEQ ID NO:62). In this chimeric construct, the DH2-encoding sequence from *Thraustochytrium* is a codon-optimized sequence for use in *Schizochytrium*. The construction of the plasmid containing SEQ ID NO:75, denoted pDD24, is described in detail in Example 3. The *Schizochytrium* OrfC upstream and downstream non-coding sequences that flank SEQ ID NO:75 in pDD24 are the same as those described above with respect to SEQ ID NO:70 (not represented in SEQ ID NO:75). SEQ ID NO:75 encodes an amino acid sequence of SEQ ID NO:74. SEQ ID NO:74 has been described in detail above with respect to SEQ ID NO:73, which also encodes SEQ ID NO:74. However, in this construct, as discussed above the nucleotide sequence encoding amino acids 516-1041 of SEQ ID NO:74 was derived from the "synthetic gene sequence" for OrfC of *Thraustochytrium*.23B that is contained in plasmid pThOrfC-synPS (see Example 1 and SEQ ID NO:70) and which employs codons that are preferred for gene expression in *Schizochytrium*. The production and use of organisms that have been transformed with this construct are described in detail below and in the Examples.

The plasmid described above as pDD24 comprises, to the best of the present inventors' knowledge, the nucleotide sequence of SEQ ID NO:75, and encodes the corresponding amino acid sequence of SEQ ID NO:74. Plasmid pDD24 (denoted pDD24, in the form of an *E. coli* plasmid vector) was deposited with the American Type Culture Collection (ATCC), 10801 University Boulevard, Manassas, Va. 20110-2209 USA on Mar. 1, 2007, and assigned ATCC Accession No. PTA-8226. The nucleotide sequence of pDD24, and the amino acid sequence encoded by this plasmid are encompassed by the present invention.

Chimeric PUFA PKS Systems

In addition to the use of codon-optimization and chimeric constructs described above, the invention includes the production and use of chimeric PUFA PKS systems. Chimeric PUFA PKS systems include the use of the chimeric constructs described above, where a chimeric PUFA PKS protein is created and used in a PUFA PKS system, but such systems also encompass PUFA PKS systems where one or more entire protein or proteins from one or more PUFA PKS system(s) are exchanged for or added to the corresponding entire protein or proteins from another PUFA PKS system, such that the resulting PUFA PKS system comprises proteins from two or more different PUFA PKS systems. Such systems can also include the use of chimeric proteins, as described above (e.g., chimeric proteins, and substitutions of whole proteins). For example, the construct described above as pTh23B_synPS (comprising a *Thraustochytrium* 23B OrfC-encoding sequence, optimized for *Schizochytrium* codon usage) can be substituted into a *Schizochytrium* PUFA PKS system to perfectly replace the native *Schizochytrium* OrfC-encoding sequence, thereby creating a chimeric PUFA PKS system. As another example, the native *Thraustochytrium* 23B OrfC-encoding sequence (not codon-optimized) can be can be substituted into a *Schizochytrium* PUFA PKS system to perfectly replace the native *Schizochytrium* OrfC-encoding sequence, thereby creating another chimeric PUFA PKS system. As yet another example, the native *Thraustochytrium* 23B OrfA- and OrfC-encoding sequences (codon-optimized, or not) can be substituted into a *Schizochytrium* PUFA PKS system to perfectly replace the native *Schizochytrium* OrfA- and OrfC-encoding sequences, respectively, thereby creating yet another chimeric PUFA PKS system. These and other chimeric PUFA PKS systems are described in the Examples below. Included in the Examples are *Schizochytrium* hosts expressing chimeric PUFA PKS systems comprised of: (1) *Schizochytrium* (S) OrfA, SOrfB, and *Thraustochytrium* (Th) OrfC; (2) SOrfA, ThOrfB, and SOrfC; (3) ThOrfA, SOrfB, and SOrfC; (4) SOrfA, ThOrfB, and ThOrfC; (5) ThOrfA, SOrfB, and ThOrfC; (6) ThOrfA, ThOrfB, and SOrfC; and (7) ThOrfA, ThOrfB, and ThOrfC.

Based on the discussion and exemplary experiments provided herein, it is now possible to improve and/or modify PUFA production by selected resynthesis of PUFA PKS nucleic acid molecules for host codon usage, and/or the use of chimeric PUFA PKS constructs and/or chimeric PUFA PKS systems in various host organisms, including in host organisms that do not endogenously have a PUFA PKS system for the production of PUFAs.

Phosphopantetheinyl transferase (PPTase)

According to the present invention, a PUFA PKS system for production and/or accumulation of PUFAs in a heterologous host or improved production and/or accumulation of PUFAs in an endogenous host may make use of various accessory proteins, which are defined herein as proteins that are not considered to be part of the core PUFA PKS system as described above (i.e., not part of the PUFA synthase enzyme complex itself), but which may be, or are, necessary for PUFA production or at least for efficient PUFA production using the core PUFA synthase enzyme complex of the present invention.

In order to produce PUFAs, a PUFA PKS system must work with an accessory protein that transfers a 4'-phosphopantetheinyl moiety from coenzyme A to the acyl carrier protein (ACP) domain(s). Therefore, a PUFA PKS system can be considered to include at least one 4'-phosphopantetheinyl transferase (PPTase) domain, or such a domain can be considered to be an accessory domain or protein to the PUFA PKS system. Structural and functional characteristics of PPTases have been described in detail, for example, in U.S. Patent Application Publication No. 20020194641; U.S. Patent Application Publication No. 20040235127; and U.S. Patent Application Publication No. 20050100995.

According to the present invention, a domain or protein having 4'-phosphopantetheinyl transferase (PPTase) biological activity (function) is characterized as the enzyme that transfers a 4'-phosphopantetheinyl moiety from Coenzyme A to the acyl carrier protein (ACP). This transfer to an invariant serine reside of the ACP activates the inactive apo-form to the holo-form. In both polyketide and fatty acid synthesis, the phosphopantetheine group forms thioesters with the growing acyl chains. The PPTases are a family of enzymes that have been well characterized in fatty acid synthesis, polyketide synthesis, and non-ribosomal peptide synthesis. The sequences of many PPTases are known, and crystal structures have been determined (e.g., Reuter K, Mofid M R, Marahiel M A, Ficner R. "Crystal structure of the surfactin synthetase-activating enzyme sfp: a prototype of the 4'-phosphopantetheinyl transferase superfamily" EMBO J. 1999 Dec. 1; 18(23): 6823-31) as well as mutational analysis of amino acid residues important for activity (Mofid M R, Finking R, Essen L O, Marahiel M A. "Structure-based mutational analysis of the 4'-phosphopantetheinyl transferases Sfp from *Bacillus subtilis*: carrier protein recognition and reaction mechanism" Biochemistry. 2004 Apr. 13; 43(14):4128-36). These invariant and highly conserved amino acids in PPTases are contained within the pfaE ORFs from both *Shewanella* strains described above.

One heterologous PPTase which has been demonstrated previously to recognize the OrfA ACP domains described herein as substrates is the Het I protein of *Nostoc* sp. PCC 7120 (formerly called *Anabaena* sp. PCC 7120). Het I is present in a cluster of genes in *Nostoc* known to be responsible for the synthesis of long chain hydroxy-fatty acids that are a component of a glyco-lipid layer present in heterocysts of that organism (Black and Wolk, 1994, *J. Bacteriol.* 176, 2282-2292; Campbell et al., 1997, *Arch. Microbiol.* 167, 251-258). Het I is likely to activate the ACP domains of a protein, Hgl E, present in that cluster. The two ACP domains of Hgl E have a high degree of sequence homology to the ACP domains found in *Schizochytrium* Orf A. SEQ ID NO:34 represents the amino acid sequence of the *Nostoc* Het I protein, and is a functional PPTase that can be used with a PUFA PKS system described herein, including the PUFA PKS systems from *Schizochytrium* and *Thraustochytrium*. SEQ ID NO:34 is encoded by SEQ ID NO:33. The endogenous start codon of Het I has not been identified (there is no methionine present in the putative protein). There are several potential alternative start codons (e.g., TTG and ATT) near the 5' end of the open reading frame. No methionine codons (ATG) are present in the sequence. However, the construction of a Het I expression construct was completed using PCR to replace the furthest 5' potential alternative start codon (TTG) with a methionine codon (ATG, as part of an NdeI restriction enzyme recognition site), and introducing an XhoI site at the 3' end of the coding sequence, and the encoded PPTase (SEQ ID NO:34) has been shown to be functional.

Another heterologous PPTase which has been demonstrated previously to recognize the OrfA ACP domains described herein as substrates is sfp, derived from *Bacillus subtilis*. Sfp has been well characterized, and is widely used due to its ability to recognize a broad range of substrates. Based on published sequence information (Nakana, et al., 1992, *Molecular and General Genetics* 232: 313-321), an expression vector was previously produced for sfp by cloning the coding region, along with defined up- and downstream flanking DNA sequences, into a pACYC-184 cloning vector. This construct encodes a functional PPTase as demonstrated by its ability to be co-expressed with *Schizochytrium* Orfs A, B*, and C in *E. coli* which, under appropriate conditions, resulted in the accumulation of DHA in those cells (see U.S. Patent Application Publication No. 20040235127).

When genetically modifying organisms (e.g., microorganisms or plants) to express a PUFA PKS system according to the present invention, some host organisms may endogenously express accessory proteins that are needed to work with the PUFA PKS to produce PUFAs (e.g., PPTases). However, some organisms may be transformed with nucleic acid molecules encoding one or more accessory proteins described herein to enable and/or to enhance production of PUFAs by the organism, even if the organism endogenously produces a homologous accessory protein (i.e., some heterologous accessory proteins may operate more effectively or efficiently with the transformed PUFA synthase proteins than the host cells' endogenous accessory protein). In one embodiment, such an accessory protein includes an accessory PPTase.

One embodiment of the present invention relates to an isolated nucleic acid molecule comprising a nucleic acid sequence from a PUFA PKS system, a homologue thereof, a fragment thereof, and/or a nucleic acid sequence that is complementary to any of such nucleic acid sequences. In one aspect, the present invention relates to an isolated nucleic acid molecule comprising a nucleic acid sequence selected from the group consisting of: (a) a nucleic acid sequence encoding an amino acid sequence selected from the group consisting of: SEQ ID NO:2, SEQ ID NO:4, SEQ ID NO:6, SEQ ID NO:39, SEQ ID NO:52, SEQ ID NO:62, and biologically active fragments thereof; (b) a nucleic acid sequence encoding an amino acid sequence selected from the group consisting of: SEQ ID NO:8, SEQ ID NO:10, SEQ ID NO:13, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:41, SEQ ID NO:43, SEQ ID NO:45, SEQ ID NO:48, SEQ ID NO:50, SEQ ID NO:54, SEQ ID NO:56, SEQ ID NO:58, SEQ ID NO:60, SEQ ID NO:64, SEQ ID NO:66, SEQ ID NO:68, and biologically active fragments thereof; (c) a nucleic acid sequence encoding an amino acid sequence that is at least about 60% identical to at least 500 consecutive amino acids of any of the amino acid sequences of (a), wherein the amino acid sequence has a biological activity of at least one, two, three or more domains of a polyunsaturated fatty acid (PUFA) polyketide synthase (PKS) system; (d) a nucleic acid sequence encoding an amino acid sequence that is at least about 60% identical to any of the amino acid sequences of (b), wherein said amino acid sequence has a biological activity of at least one domain of a polyunsaturated fatty acid (PUFA) polyketide synthase (PKS) system; or (e) a nucleic acid sequence that is fully complementary to the nucleic acid sequence of (a), (b), (c), or (d). In a further embodiment, nucleic acid sequences including a sequence encoding the active site domains or other functional motifs described above for several of the PUFA PKS domains are encompassed by the invention.

Particularly preferred embodiments of the present invention include isolated nucleic acid molecules encoding chimeric proteins useful in a PUFA PKS system as described herein. The present invention includes the use of any domain or protein from or derived from one PUFA PKS system in a domain and/or with proteins from or derived from another PUFA PKS system in order to create novel PUFA PKS systems with unique qualities.

For example, one embodiment of the present invention relates to the use of a DH2 domain from a PUFA PKS system to modify a PUFA PKS system comprised of proteins/domains from a different organism or organisms, wherein the introduction of the DH2 domain (e.g., in one embodiment, by substitution for the endogenous DH2 domain or similar domain in the host) modifies the ratio of PUFAs produced by the system, and particularly the ratio of omega-3 to omega-6 PUFAs produced by the system. This embodiment is described in detail below.

Some preferred nucleic acid molecules include a nucleic acid sequence encoding an amino acid sequence of SEQ ID NO:74, and biologically active fragments thereof, a nucleic acid sequence encoding an amino acid sequence that is at least about 60% identical to SEQ ID NO:74 having biological activity of at least one, two, three or more domains of a polyunsaturated fatty acid (PUFA) polyketide synthase (PKS) system, or a nucleic acid sequence that is fully complementary to the nucleic acid sequences above. In one embodiment, the nucleic acid molecule includes a nucleic acid sequence selected from SEQ ID NO:73 and SEQ ID NO:75. In one embodiment, the nucleic acid molecule includes a nucleic acid sequence encoding the amino acid sequence encoded by a plasmid selected from the group of pDS49 and pDD24. In one embodiment, the nucleic acid molecule includes the nucleic acid sequence of a plasmid selected from the group of pDS49 and pDD24 that encodes a chimeric OrfC protein.

Other preferred embodiments including nucleic acid molecules comprising a nucleic acid sequence encoding a PUFA PKS protein or domain or homologue thereof from one PUFA PKS system, wherein the nucleic acid sequence is optimized for the codon usage of a different organism, such as a host in which the nucleic acid sequence is to be expressed. Examples of such nucleic acid sequences are described herein, and include, but are not limited to, the nucleic acid sequences represented by SEQ ID NO:70, SEQ ID NO:71, and SEQ ID NO:72, as well as SEQ ID NO:75. Codon optimized nucleic acid sequences encoding any PUFA PKS protein or domain, and particularly, any of the amino acid sequences described herein are encompassed by the invention. In one embodiment, such a nucleic acid molecule includes a nucleic acid sequence encoding the amino acid sequence encoded by a plasmid selected from the group of pThOrfC-synPS, pDD26, pDD32, or pDD24. In one embodiment, the nucleic acid molecule includes the nucleic acid sequence of a plasmid selected from pThOrfC-synPS, pDD26, pDD32, or pDD24 that encodes a protein or chimeric protein useful in a PUFA PKS system.

According to the present invention, an amino acid sequence that has a biological activity of at least one domain of a PUFA PKS system is an amino acid sequence that has the biological activity of at least one domain of the PUFA PKS system described in detail herein, as exemplified by the *Schizochytrium* and *Thraustochytrium* PUFA PKS systems, and as further exemplified by the described biological activities of any of the proteins and domains in any of the PUFA PKS systems described in U.S. Pat. No. 6,140,486, U.S. Pat. No. 6,566,583, U.S. Patent Application Publication No. 20020194641, U.S. Patent Application Publication No. 20070089199, U.S. Patent Application Publication No. 20040235127, U.S. Patent Application Publication No. 20050100995, PCT Patent Publication No. WO 05/097982, or U.S. Patent Application Publication No. 20050014231, supra.

Accordingly, an isolated nucleic acid molecule of the present invention can encode the translation product of any PUFA PKS open reading frame, PUFA PKS domain, biologically active fragment thereof, or any homologue of a naturally occurring PUFA PKS open reading frame or domain which has biological activity. A homologue of given protein or domain is a protein or polypeptide that has an amino acid sequence which differs from the naturally occurring reference amino acid sequence (i.e., of the reference protein or domain) in that at least one or a few, but not limited to one or a few, amino acids have been deleted (e.g., a truncated version of the protein, such as a peptide or fragment), inserted, inverted, substituted and/or derivatized (e.g., by glycosylation, phosphorylation, acetylation, myristoylation, prenylation, palmitation, amidation and/or addition of glycosylphosphatidyl inositol). Preferred homologues of a PUFA PKS protein or domain are described in detail below. It is noted that homologues can include synthetically produced homologues, naturally occurring allelic variants of a given protein or domain, or homologous sequences from organisms other than the organism from which the reference sequence was derived.

In general, the biological activity or biological action of a protein or domain refers to any function(s) exhibited or performed by the protein or domain that is ascribed to the naturally occurring form of the protein or domain as measured or observed in vivo (i.e., in the natural physiological environment of the protein) or in vitro (i.e., under laboratory conditions). Biological activities of PUFA PKS systems and the individual proteins/domains that make up a PUFA PKS system have been described in detail elsewhere herein. Modifications of a protein or domain, such as in a homologue or mimetic (discussed below), may result in proteins or domains having the same biological activity as the naturally occurring protein or domain, or in proteins or domains having decreased or increased biological activity as compared to the naturally occurring protein or domain. Modifications which result in a decrease in expression or a decrease in the activity of the protein or domain, can be referred to as inactivation (complete or partial), down-regulation, or decreased action of a protein or domain. Similarly, modifications which result in an increase in expression or an increase in the activity of the protein or domain, can be referred to as amplification, overproduction, activation, enhancement, up-regulation or increased action of a protein or domain. A functional domain of a PUFA PKS system is a domain (i.e., a domain can be a portion of a protein) that is capable of performing a biological function (i.e., has biological activity).

In accordance with the present invention, an isolated nucleic acid molecule is a nucleic acid molecule that has been removed from its natural milieu (i.e., that has been subject to human manipulation), its natural milieu being the genome or chromosome in which the nucleic acid molecule is found in nature. As such, "isolated" does not necessarily reflect the extent to which the nucleic acid molecule has been purified, but indicates that the molecule does not include an entire genome or an entire chromosome in which the nucleic acid molecule is found in nature. An isolated nucleic acid molecule can include a gene. An isolated nucleic acid molecule that includes a gene is not a fragment of a chromosome that includes such gene, but rather includes the coding region and regulatory regions associated with the gene, but typically no additional genes naturally found on the same chromosome, although some nucleic acid molecules may include nearby/linked genes that are not necessarily a part of the PUFA PKS gene or system. An isolated nucleic acid molecule can also include a specified nucleic acid sequence flanked by (i.e., at the 5' and/or the 3' end of the sequence) additional nucleic acids that do not normally flank the specified nucleic acid sequence in nature (i.e., heterologous sequences). Isolated nucleic acid molecule can include DNA, RNA (e.g., mRNA), or derivatives of either DNA or RNA (e.g., cDNA). Although the phrase "nucleic acid molecule" primarily refers to the physical nucleic acid molecule and the phrase "nucleic acid sequence" primarily refers to the sequence of nucleotides on the nucleic acid molecule, the two phrases can be used interchangeably, especially with respect to a nucleic acid molecule, or a nucleic acid sequence, being capable of encoding a protein or domain of a protein.

Preferably, an isolated nucleic acid molecule of the present invention is produced using recombinant DNA technology (e.g., polymerase chain reaction (PCR) amplification, cloning) or chemical synthesis. Isolated nucleic acid molecules include natural nucleic acid molecules and homologues thereof, including, but not limited to, natural allelic variants and modified nucleic acid molecules in which nucleotides have been inserted, deleted, substituted, and/or inverted in such a manner that such modifications provide the desired effect on PUFA PKS system biological activity as described herein. Protein homologues (e.g., proteins encoded by nucleic acid homologues) have been discussed in detail above.

A nucleic acid molecule homologue can be produced using a number of methods known to those skilled in the art (see, for example, Sambrook et al., *Molecular Cloning: A Laboratory Manual*, Cold Spring Harbor Labs Press, 1989). For example, nucleic acid molecules can be modified using a variety of techniques including, but not limited to, classic mutagenesis techniques and recombinant DNA techniques, such as site-directed mutagenesis, chemical treatment of a nucleic acid molecule to induce mutations, restriction enzyme cleavage of a nucleic acid fragment, ligation of nucleic acid fragments, PCR amplification and/or mutagenesis of selected regions of a nucleic acid sequence, synthesis of oligonucleotide mixtures and ligation of mixture groups to "build" a mixture of nucleic acid molecules and combinations thereof. Nucleic acid molecule homologues can be selected from a mixture of modified nucleic acids by screening for the function of the protein encoded by the nucleic acid and/or by hybridization with a wild-type gene.

The minimum size of a nucleic acid molecule of the present invention is a size sufficient to form a probe or oligonucleotide primer that is capable of forming a stable hybrid (e.g., under moderate, high or very high stringency conditions) with the complementary sequence of a nucleic acid molecule useful in the present invention, or of a size sufficient to encode an amino acid sequence having a biological activity of at least one domain of a PUFA PKS system according to the present invention. As such, the size of the nucleic acid molecule encoding such a protein can be dependent on nucleic acid composition and percent homology or identity between the nucleic acid molecule and complementary sequence as well as upon hybridization conditions per se (e.g., temperature, salt concentration, and formamide concentration). The minimal size of a nucleic acid molecule that is used as an oligonucleotide primer or as a probe is typically at least about 12 to about 15 nucleotides in length if the nucleic acid molecules are GC-rich and at least about 15 to about 18 bases in length if they are AT-rich. There is no limit, other than a practical limit, on the maximal size of a nucleic acid molecule of the present invention, in that the nucleic acid molecule can include a sequence sufficient to encode a biologically active fragment of a domain of a PUFA PKS system, an entire domain of a PUFA PKS system, several domains within an open reading frame (Orf) of a PUFA PKS system, an entire Orf of a PUFA PKS system, or more than one Orf of a PUFA PKS system.

In one embodiment of the present invention, an isolated nucleic acid molecule comprises, consists essentially of, or consists of a nucleic acid sequence encoding an amino acid sequence selected from the group of: SEQ ID NO:2, SEQ ID NO:4, SEQ ID NO:6, SEQ ID NO:8, SEQ ID NO:10, SEQ ID NO:13, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:39, SEQ ID NO:41, SEQ ID NO:43, SEQ ID NO:45, SEQ ID NO:48, SEQ ID NO:50, SEQ ID NO:52, SEQ ID NO:54, SEQ ID NO:56, SEQ ID NO:58, SEQ ID NO:60, SEQ ID NO: 62, SEQ ID NO:64, SEQ ID NO:66, SEQ ID NO:68, or SEQ ID NO:74, or biologically active fragments thereof. In one aspect, the nucleic acid sequence is selected from: SEQ ID NO:1, SEQ ID NO:3, SEQ ID NO:5, SEQ ID NO:7, SEQ ID NO:9, SEQ ID NO:12, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:34, SEQ ID NO:36, SEQ ID NO:37, SEQ ID NO:38, SEQ ID NO:40, SEQ ID NO:42, SEQ ID NO:44, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:70, SEQ ID NO:71, SEQ ID NO:72, SEQ ID NO:73, or SEQ ID NO:75.

In one embodiment of the present invention, any of the above-described PUFA PKS amino acid sequences, as well as homologues of such sequences, can be produced with from at least one, and up to about 20, additional heterologous amino acids flanking each of the C- and/or N-terminal end of the given amino acid sequence. The resulting protein or polypeptide can be referred to as "consisting essentially of" a given amino acid sequence. According to the present invention, the heterologous amino acids are a sequence of amino acids that are not naturally found (i.e., not found in nature, in vivo) flanking the given amino acid sequence or which would not be encoded by the nucleotides that flank the naturally occurring nucleic acid sequence encoding the given amino acid sequence as it occurs in the gene, if such nucleotides in the naturally occurring sequence were translated using standard codon usage for the organism from which the given amino acid sequence is derived. Similarly, the phrase "consisting essentially of", when used with reference to a nucleic acid sequence herein, refers to a nucleic acid sequence encoding a given amino acid sequence that can be flanked by from at least one, and up to as many as about 60, additional heterologous nucleotides at each of the 5' and/or the 3' end of the nucleic acid sequence encoding the given amino acid sequence. The heterologous nucleotides are not naturally found (i.e., not found in nature, in vivo) flanking the nucleic acid sequence encoding the given amino acid sequence as it occurs in the natural gene.

The present invention also includes an isolated nucleic acid molecule comprising a nucleic acid sequence encoding an amino acid sequence having a biological activity of at least one domain of a PUFA PKS system. In one aspect, such a nucleic acid sequence encodes a homologue of any of the PUFA PKS proteins or domains described above, wherein the homologue has a biological activity of at least one (or two, three, four or more) domain of a PUFA PKS system as described previously herein.

In one aspect of the invention, a homologue of a PUFA PKS protein or domain encompassed by the present invention comprises an amino acid sequence that is at least about 60% identical to at least 500 consecutive amino acids of an amino acid sequence chosen from: SEQ ID NO:2, SEQ ID NO:4, SEQ ID NO:6, SEQ ID NO:39, SEQ ID NO:52, SEQ ID NO:62 or SEQ ID NO:74; wherein said amino acid sequence has a biological activity of at least one domain of a PUFA PKS system. In a further aspect, the amino acid sequence of the homologue is at least about 60% identical to at least about 600 consecutive amino acids, and more preferably to at least about 700 consecutive amino acids, and more preferably to at least about 800 consecutive amino acids, and more preferably to at least about 900 consecutive amino acids, and more preferably to at least about 1000 consecutive amino acids, and more preferably to at least about 1100 consecutive amino acids, and more preferably to at least about 1200 consecutive amino acids, and more preferably to at least about 1300 consecutive amino acids, and more preferably to at least about 1400 consecutive amino acids, and more preferably to at least about 1500 consecutive amino acids of any of SEQ ID NO:2, SEQ ID NO:4, SEQ ID NO:6, SEQ ID NO:39, SEQ ID NO:52, SEQ ID NO:62, or SEQ ID NO:74, or to the full length of SEQ ID NO:6, SEQ ID NO:62, or SEQ ID NO:74. In a further aspect, the amino acid sequence of the homologue is at least about 60% identical to at least about 1600 consecutive amino acids, and more preferably to at least about 1700 consecutive amino acids, and more preferably to at least about 1800 consecutive amino acids, and more preferably to at least about 1900 consecutive amino acids, and more preferably to at least about 2000 consecutive amino acids of any of SEQ ID NO:2, SEQ ID NO:4, SEQ ID NO:39, or SEQ ID NO:52 or to the full length of SEQ ID NO:4 or SEQ ID NO:52. In a further aspect, the amino acid sequence of the homologue is at least about 60% identical to at least about 2100 consecutive amino acids, and more preferably to at least about 2200 consecutive amino acids, and more preferably to at least about 2300 consecutive amino acids, and more preferably to at least about 2400 consecutive amino acids, and more preferably to at least about 2500 consecutive amino acids, and more preferably to at least about 2600 consecutive amino acids, and more preferably to at least about 2700 consecutive amino acids, and more preferably to at least about 2800 consecutive amino acids, and even more preferably, to the full length of SEQ ID NO:2 or SEQ ID NO:39.

In another aspect, a homologue of a PUFA PKS protein or domain encompassed by the present invention comprises an amino acid sequence that is at least about 65% identical, and more preferably at least about 70% identical, and more preferably at least about 75% identical, and more preferably at least about 80% identical, and more preferably at least about 85% identical, and more preferably at least about 90% identical, and more preferably at least about 95% identical, and more preferably at least about 96% identical, and more preferably at least about 97% identical, and more preferably at least about 98% identical, and more preferably at least about 99% identical to any of the above-described amino acid sequences, over any of the consecutive amino acid lengths described in the paragraphs above, wherein the amino acid sequence has a biological activity of at least one domain of a PUFA PKS system.

In one aspect of the invention, a homologue of a PUFA PKS protein or domain encompassed by the present invention comprises an amino acid sequence that is at least about 60% identical to an amino acid sequence chosen from: SEQ ID NO:8, SEQ ID NO:10, SEQ ID NO:13, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:41, SEQ ID NO:43, SEQ ID NO:45, SEQ ID NO:48, SEQ ID NO:50, SEQ ID NO:54, SEQ ID NO:56, SEQ ID NO:58, SEQ ID NO:60, SEQ ID NO:64, SEQ ID NO:66, SEQ ID NO:68, or amino acid sequences comprising combinations of any such amino acid sequences, wherein said amino acid sequence has a biological activity of at least one domain of a PUFA PKS system or accessory protein thereof. In a further aspect, the amino acid sequence of the homologue is at least about 65% identical, and more preferably at least about 70% identical, and more preferably at least about 75% identical, and more preferably at least about 80% identical, and more preferably at least about 85% identical, and more preferably at least about 90% identical, and more preferably at least about 95% identical, and more preferably at least about 96% identical, and more preferably at least about 97% identical, and more preferably at least about 98% identical, and more preferably at least about 99% identical to any of the above-described amino acid sequences, wherein the amino acid sequence has a biological activity of at least one domain of a PUFA PKS system or accessory protein thereof.

According to the present invention, the term "contiguous" or "consecutive", with regard to nucleic acid or amino acid sequences described herein, means to be connected in an unbroken sequence. For example, for a first sequence to comprise 30 contiguous (or consecutive) amino acids of a second sequence, means that the first sequence includes an unbroken sequence of 30 amino acid residues that is 100% identical to an unbroken sequence of 30 amino acid residues in the second sequence. Similarly, for a first sequence to have "100% identity" with a second sequence means that the first sequence exactly matches the second sequence with no gaps between nucleotides or amino acids.

As used herein, unless otherwise specified, reference to a percent (%) identity refers to an evaluation of homology which is performed using: (1) a BLAST 2.0 Basic BLAST homology search using blastp for amino acid searches, blastn for nucleic acid searches, and blastX for nucleic acid searches and searches of translated amino acids in all 6 open reading frames, all with standard default parameters, wherein the query sequence is filtered for low complexity regions by default (described in Altschul, S. F., Madden, T. L., Schääffer, A. A., Zhang, J., Zhang, Z., Miller, W. & Lipman, D. J. (1997) "Gapped BLAST and PSI-BLAST: a new generation of protein database search programs." Nucleic Acids Res. 25:3389-3402, incorporated herein by reference in its entirety); (2) a BLAST 2 alignment (using the parameters described below); (3) and/or PSI-BLAST with the standard default parameters (Position-Specific Iterated BLAST). It is noted that due to some differences in the standard parameters between BLAST 2.0 Basic BLAST and BLAST 2, two specific sequences might be recognized as having significant homology using the BLAST 2 program, whereas a search performed in BLAST 2.0 Basic BLAST using one of the sequences as the query sequence may not identify the second sequence in the top matches. In addition, PSI-BLAST provides an automated, easy-to-use version of a "profile" search, which is a sensitive way to look for sequence homologues. The program first performs a gapped BLAST database search. The PSI-BLAST program uses the information from any significant alignments returned to construct a position-specific score matrix, which replaces the query sequence for the next round of database searching. Therefore, it is to be understood that percent identity can be determined by using any one of these programs.

Two specific sequences can be aligned to one another using BLAST 2 sequence as described in Tatusova and Madden, (1999), "Blast 2 sequences—a new tool for comparing protein and nucleotide sequences", FEMS Microbiol Lett. 174: 247-250, incorporated herein by reference in its entirety. BLAST 2 sequence alignment is performed in blastp or blastn using the BLAST 2.0 algorithm to perform a Gapped BLAST search (BLAST 2.0) between the two sequences allowing for the introduction of gaps (deletions and insertions) in the resulting alignment. For purposes of clarity herein, a BLAST 2 sequence alignment is performed using the standard default parameters as follows.

For blastn, using 0 BLOSUM62 matrix:
Reward for match=1
Penalty for mismatch=−2
Open gap (5) and extension gap (2) penalties
gap x_dropoff (50) expect (10) word size (11) filter (on)
For blastp, using 0 BLOSUM62 matrix:
Open gap (11) and extension gap (1) penalties
gap x_dropoff (50) expect (10) word size (3) filter (on).

In another embodiment of the invention, an amino acid sequence having the biological activity of at least one domain of a PUFA PKS system of the present invention includes an amino acid sequence that is sufficiently similar to a naturally occurring PUFA PKS protein or polypeptide that a nucleic acid sequence encoding the amino acid sequence is capable of hybridizing under moderate, high, or very high stringency conditions (described below) to (i.e., with) a nucleic acid molecule encoding the naturally occurring PUFA PKS protein or polypeptide (i.e., to the complement of the nucleic acid strand encoding the naturally occurring PUFA PKS protein or polypeptide). Preferably, an amino acid sequence having the biological activity of at least one domain of a PUFA PKS system of the present invention is encoded by a nucleic acid sequence that hybridizes under moderate, high or very high stringency conditions to the complement of a nucleic acid sequence that encodes a protein comprising an amino acid sequence represented by any of the amino acid sequences described herein.

In another embodiment of the invention, a nucleotide sequence of the present invention is a nucleotide sequence isolated from (obtainable from), identical to, or a homologue of, the nucleotide sequence from a *Schizochytrium*, wherein the nucleotide sequence from a *Schizochytrium* (including either strand of a DNA molecule from *Schizochytrium*) hybridizes under moderate, high, or very high stringency conditions to a nucleotide sequence encoding an amino acid sequence represented by any of SEQ ID NO:2, SEQ ID NO:4, SEQ ID NO:6, SEQ ID NO:8, SEQ ID NO:10, SEQ ID NO:13, SEQ ID NO:18, SEQ ID NO:20, SEQ ID NO:22, SEQ ID NO:24, SEQ ID NO:26, SEQ ID NO:28, SEQ ID NO:30, or SEQ ID NO:32. In one embodiment, the *Schizochytrium* is *Schizochytrium* ATCC 20888. In another embodiment, the *Schizochytrium* is a daughter strain of *Schizochytrium* 20888, including mutated strains thereof (e.g., N230D). In one embodiment, the nucleic acid sequence hybridizes under moderate, high, or very high stringency conditions to a nucleotide sequence selected from: SEQ ID NO:1, SEQ ID NO:3, SEQ ID NO:5, SEQ ID NO:7, SEQ ID NO:9, SEQ ID NO:12, SEQ ID NO:17, SEQ ID NO:19, SEQ ID NO:21, SEQ ID NO:23, SEQ ID NO:25, SEQ ID NO:27, SEQ ID NO:29, or SEQ ID NO:31.

In another embodiment of the invention, a nucleotide sequence of the present invention is a nucleotide sequence isolated from (obtainable from), identical to, or a homologue of, the nucleotide sequence from a *Thraustochytrium*, wherein the nucleotide sequence from a *Thraustochytrium* (including either strand of a DNA molecule from *Thraustochytrium*) hybridizes under moderate, high, or very high stringency conditions to a nucleotide sequence encoding an amino acid sequence represented by any of SEQ ID NO:39, SEQ ID NO:41, SEQ ID NO:43, SEQ ID NO:45, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68. In one embodiment, the *Thraustochytrium* is *Thraustochytrium* 23B (ATCC 20892). In one embodiment, the nucleic acid sequence hybridizes under moderate, high, or very high stringency conditions to a nucleotide sequence selected from: SEQ ID NO:38, SEQ ID NO:40, SEQ ID NO:42, SEQ ID NO:44, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, or SEQ ID NO:67.

In yet another embodiment, a nucleotide sequence of the present invention is a nucleotide sequence isolated from (obtainable from), identical to, or a homologue of, the nucleotide sequence from a eukaryotic organism (e.g., a thraustochytrid or a labyrinthulid) or a marine bacterium, wherein the nucleotide sequence hybridizes under moderate, high, or very high stringency conditions to a nucleotide sequence encoding any of the amino acid sequences represented herein.

In another embodiment, a nucleotide sequence of the present invention is a nucleotide sequence isolated from (obtainable from), identical to, or a homologue of, any nucleotide sequence encoding an accessory protein described herein (including either strand of a DNA molecule), where, in one embodiment, the nucleotide sequence hybridizes under moderate, high, or very high stringency conditions to a nucleotide sequence encoding an amino acid sequence represented by SEQ ID NO:34. In one embodiment, the nucleic acid sequence hybridizes under moderate, high, or very high stringency conditions to a nucleotide sequence represented by SEQ ID NO:33.

In another embodiment, a nucleotide sequence of the present invention is a nucleotide sequence isolated from (obtainable from), identical to, or a homologue of, any codon-optimized or chimeric nucleotide sequence described herein (including either strand of a DNA molecule), where, in one embodiment, the nucleotide sequence hybridizes under moderate, high, or very high stringency conditions to a nucleotide sequence encoding an amino acid sequence represented by SEQ ID NO:74. In one embodiment, the nucleic acid sequence hybridizes under moderate, high, or very high stringency conditions to a nucleotide sequence selected from SEQ ID NO:35, SEQ ID NO:36, SEQ ID NO:37, SEQ ID NO:69, SEQ ID NO:70, SEQ ID NO:71, SEQ ID NO:72, SEQ ID NO:73, or SEQ ID NO:75.

Methods to deduce a complementary sequence are known to those skilled in the art. It should be noted that since amino acid sequencing and nucleic acid sequencing technologies are not entirely error-free, the sequences presented herein, at best, represent apparent sequences of PUFA PKS domains and proteins of the present invention, or of the nucleotide sequences encoding such amino acid sequences.

As used herein, hybridization conditions refer to standard hybridization conditions under which nucleic acid molecules are used to identify similar nucleic acid molecules. Such standard conditions are disclosed, for example, in Sambrook et al., *Molecular Cloning: A Laboratory Manual*, Cold Spring Harbor Labs Press, 1989. Sambrook et al., ibid., is incorporated by reference herein in its entirety (see specifically, pages 9.31-9.62). In addition, formulae to calculate the appropriate hybridization and wash conditions to achieve hybridization permitting varying degrees of mismatch of nucleotides are disclosed, for example, in Meinkoth et al., 1984, *Anal. Biochem.* 138, 267-284; Meinkoth et al., ibid., is incorporated by reference herein in its entirety.

More particularly, moderate stringency hybridization and washing conditions, as referred to herein, refer to conditions which permit isolation of nucleic acid molecules having at least about 70% nucleic acid sequence identity with the nucleic acid molecule being used to probe in the hybridization reaction (i.e., conditions permitting about 30% or less mismatch of nucleotides). High stringency hybridization and washing conditions, as referred to herein, refer to conditions which permit isolation of nucleic acid molecules having at least about 80% nucleic acid sequence identity with the nucleic acid molecule being used to probe in the hybridization reaction (i.e., conditions permitting about 20% or less mismatch of nucleotides). Very high stringency hybridization and washing conditions, as referred to herein, refer to conditions which permit isolation of nucleic acid molecules having at least about 90% nucleic acid sequence identity with the nucleic acid molecule being used to probe in the hybridization reaction (i.e., conditions permitting about 10% or less mismatch of nucleotides). As discussed above, one of skill in the art can use the formulae in Meinkoth et al., ibid. to calculate the appropriate hybridization and wash conditions to achieve these particular levels of nucleotide mismatch. Such conditions will vary, depending on whether DNA:RNA or DNA:DNA hybrids are being formed. Calculated melting temperatures for DNA:DNA hybrids are 10° C. less than for DNA:RNA hybrids. In particular embodiments, stringent hybridization conditions for DNA:DNA hybrids include hybridization at an ionic strength of 6×SSC (0.9 M Na$^+$) at a temperature of between about 20° C. and about 35° C. (lower stringency), more preferably, between about 28° C. and about 40° C. (more stringent), and even more preferably, between about 35° C. and about 45° C. (even more stringent), with appropriate wash conditions. In particular embodiments, stringent hybridization conditions for DNA:RNA hybrids include hybridization at an ionic strength of 6×SSC (0.9 M Na$^+$) at a temperature of between about 30° C. and about 45° C., more preferably, between about 38° C. and about 50° C., and even more preferably, between about 45° C. and about 55° C., with similarly stringent wash conditions. These values are based on calculations of a melting temperature for molecules larger than about 100 nucleotides, 0% formamide and a G+C content of about 40%. Alternatively, $T_m$ can be calculated empirically as set forth in Sambrook et al., supra, pages 9.31 to 9.62. In general, the wash conditions should be as stringent as possible, and should be appropriate for the chosen hybridization conditions. For example, hybridization conditions can include a combination of salt and temperature conditions that are approximately 20-25° C. below the calculated $T_m$ of a particular hybrid, and wash conditions typically include a combination of salt and temperature conditions that are approximately 12-20° C. below the calculated $T_m$ of the particular hybrid. One example of hybridization conditions suitable for use with DNA:DNA hybrids includes a 2-24 hour hybridization in 6×SSC (50% formamide) at about 42° C., followed by washing steps that include one or more washes at room temperature in about 2×SSC, followed by additional washes at higher temperatures and lower ionic strength (e.g., at least one wash as about 37° C. in about 0.1×-0.5×SSC, followed by at least one wash at about 68° C. in about 0.1×-0.5×SSC).

Yet another embodiment of the present invention includes a nucleic acid molecule comprising, consisting essentially of, or consisting of, a nucleic acid sequence that is identical to, or that is a homologue of (as defined above) the nucleic acid sequence of a plasmid selected from: pJK1126 (ATCC Accession No. PTA-7648), pJK1129 (ATCC Accession No. PTA-7649), pJK1131 (ATCC Accession No. PTA-7650), pJK306 (ATCC Accession No. PTA-7641), pJK320 (ATCC Accession No. PTA-7644), pJK324 (ATCC Accession No. PTA-7643), pBR002 (ATCC Accession No. PTA-7642), Th23BOrfA_pBR812.1 (ATCC Accession No. PTA-8232) Th23BOrfA_pBR811 (ATCC Accession No. PTA-8231), Th23BOrfB_pBR800 (ATCC Accession No. PTA-8227) or Th23BOrfC_pBR709A (ATCC Accession No. PTA-8228).

In another embodiment, the present invention includes a nucleic acid molecule comprising, consisting essentially of, or consisting of, a nucleic acid sequence that is identical to, or that is a homologue of (as defined above), the nucleic acid sequence of a plasmid selected from: pThOrfC-synPS (ATCC Accession No. PTA-8229), pDS49 (ATCC Accession No. PTA-8230), pDD24 (ATCC Accession No. PTA-8226), pDD26 (ATCC Accession No. PTA-8411), pDD32 (ATCC Accession No. PTA-8412), or OrfB*_pJK780 (ATCC Accession No. PTA-8225).

Yet another embodiment of the present invention includes a nucleic acid molecule comprising, consisting essentially of, or consisting of, a nucleic acid sequence that encodes an amino acid sequence that is identical to, or that is a homologue of (as defined above) the amino acid sequence encoded by a plasmid selected from: pJK1126 (ATCC Accession No. PTA-7648), pJK1129 (ATCC Accession No. PTA-7649), pJK1131 (ATCC Accession No. PTA-7650), pJK306 (ATCC Accession No. PTA-7641), pJK320 (ATCC Accession No. PTA-7644), pJK324 (ATCC Accession No. PTA-7643), pBR002 (ATCC Accession No. PTA-7642), Th23BOrfA_pBR812.1 (ATCC Accession No. PTA-8232) Th23BOrfA_pBR811 (ATCC Accession No. PTA-8231), Th23BOrfB_pBR800 (ATCC Accession No. PTA-8227) or Th23BOrfC_pBR709A (ATCC Accession No. PTA-8228).

In another embodiment, the present invention includes a nucleic acid molecule comprising, consisting essentially of, or consisting of, a nucleic acid sequence that encodes an amino acid sequence that is identical to, or that is a homologue of (as defined above) the amino acid sequence encoded by a plasmid selected from: pThOrfC-synPS (ATCC Accession No. PTA-8229), pDS49 (ATCC Accession No. PTA-8230), pDD24 (ATCC Accession No. PTA-8226), pDD26 (ATCC Accession No. PTA-8411), pDD32 (ATCC Accession No. PTA-8412), or OrfB*_pJK780 (ATCC Accession No. PTA-8225).

Another embodiment of the present invention includes a recombinant nucleic acid molecule comprising a recombinant vector and a nucleic acid molecule comprising a nucleic acid sequence encoding an amino acid sequence having a biological activity of at least one domain or protein of a PUFA PKS system as described herein. Such nucleic acid sequences and domains or proteins are described in detail above. According to the present invention, a recombinant vector is an engineered (i.e., artificially produced) nucleic acid molecule that is used as a tool for manipulating a nucleic acid sequence of choice and for introducing such a nucleic acid sequence into a host cell. The recombinant vector is therefore suitable for use in cloning, sequencing, and/or otherwise manipulating the nucleic acid sequence of choice, such as by expressing and/or delivering the nucleic acid sequence of choice into a host cell to form a recombinant cell. Such a vector typically contains heterologous nucleic acid sequences, that is nucleic acid sequences that are not naturally found adjacent to nucleic acid sequence to be cloned or delivered, although the vector can also contain regulatory nucleic acid sequences (e.g., promoters, untranslated regions) which are naturally found adjacent to nucleic acid molecules of the present invention or which are useful for expression of the nucleic acid molecules of the present invention (discussed in detail below). The vector can be either RNA or DNA, either prokaryotic or eukaryotic, and typically is a plasmid. The vector can be maintained as an extrachromosomal element (e.g., a plasmid) or it can be integrated into the chromosome of a recombinant organism (e.g., a microbe or a plant). The entire vector can remain in place within a host cell, or under certain conditions, the plasmid DNA can be deleted, leaving behind the nucleic acid molecule of the present invention. The integrated nucleic acid molecule can be under chromosomal promoter control, under native or plasmid promoter control, or under a combination of several promoter controls. Single or multiple copies of the nucleic acid molecule can be integrated into the chromosome. A recombinant vector of the present invention can contain at least one selectable marker.

In one embodiment, a recombinant vector used in a recombinant nucleic acid molecule of the present invention is an expression vector. As used herein, the phrase "expression vector" is used to refer to a vector that is suitable for production of an encoded product (e.g., a protein of interest). In this embodiment, a nucleic acid sequence encoding the product to be produced (e.g., a PUFA PKS domain) is inserted into the recombinant vector to produce a recombinant nucleic acid molecule. The nucleic acid sequence encoding the protein to be produced is inserted into the vector in a manner that operatively links the nucleic acid sequence to regulatory sequences in the vector which enable the transcription and translation of the nucleic acid sequence within the recombinant host cell.

In another embodiment, a recombinant vector used in a recombinant nucleic acid molecule of the present invention is a targeting vector. As used herein, the phrase "targeting vector" is used to refer to a vector that is used to deliver a particular nucleic acid molecule into a recombinant host cell, wherein the nucleic acid molecule is used to delete or inactivate an endogenous gene within the host cell or microorganism (i.e., used for targeted gene disruption or knock-out technology). Such a vector may also be known in the art as a "knock-out" vector. In one aspect of this embodiment, a portion of the vector, but more typically, the nucleic acid molecule inserted into the vector (i.e., the insert), has a nucleic acid sequence that is homologous to a nucleic acid sequence of a target gene in the host cell (i.e., a gene which is targeted to be deleted or inactivated). The nucleic acid sequence of the vector insert is designed to bind to the target gene such that the target gene and the insert undergo homologous recombination, whereby the endogenous target gene is deleted, inactivated or attenuated (i.e., by at least a portion of the endogenous target gene being mutated or deleted).

Typically, a recombinant nucleic acid molecule includes at least one nucleic acid molecule of the present invention operatively linked to one or more transcription control sequences. As used herein, the phrase "recombinant molecule" or "recombinant nucleic acid molecule" primarily refers to a nucleic acid molecule or nucleic acid sequence operatively linked to a transcription control sequence, but can be used interchangeably with the phrase "nucleic acid molecule", when such nucleic acid molecule is a recombinant molecule as discussed herein. According to the present invention, the phrase "operatively linked" refers to linking a nucleic acid molecule to a transcription control sequence in a manner such that the molecule is able to be expressed when transfected (i.e., transformed, transduced, transfected, conjugated or conduced) into a host cell. Transcription control sequences are sequences which control the initiation, elongation, or termination of transcription. Particularly important transcription control sequences are those which control transcription initiation, such as promoter, enhancer, operator and repressor sequences. Suitable transcription control sequences include any transcription control sequence that can function in a host cell or organism into which the recombinant nucleic acid molecule is to be introduced.

Recombinant nucleic acid molecules of the present invention can also contain additional regulatory sequences, such as translation regulatory sequences, origins of replication, and other regulatory sequences that are compatible with the recombinant cell. In one embodiment, a recombinant molecule of the present invention, including those which are integrated into the host cell chromosome, also contains secretory signals (i.e., signal segment nucleic acid sequences) to enable an expressed protein to be secreted from the cell that produces the protein. Suitable signal segments include a signal segment that is naturally associated with the protein to be expressed or any heterologous signal segment capable of directing the secretion of the protein according to the present invention. In another embodiment, a recombinant molecule of the present invention comprises a leader sequence to enable an expressed protein to be delivered to and inserted into the membrane of a host cell. Suitable leader sequences include a leader sequence that is naturally associated with the protein, or any heterologous leader sequence capable of directing the delivery and insertion of the protein to the membrane of a cell.

The present inventors have found that the *Schizochytrium* and *Thraustochytrium* PUFA PKS Orfs A and B are closely linked in the genome and the region between the Orfs has been sequenced. In *Schizochytrium*, the Orfs are oriented in opposite directions and 4244 base pairs separate the start (ATG) codons (i.e. they are arranged as follows: 3'OrfA5'-4244 bp-5'OrfB3'). Examination of the 4244 bp intergenic region did not reveal any obvious Orfs (no significant matches were found on a BlastX search). Both Orfs A and B are highly expressed in *Schizochytrium*, at least during the time of oil production, implying that active promoter elements are embedded in this intergenic region. These genetic elements are believed to have utility as a bi-directional promoter sequence for transgenic applications. For example, in a preferred embodiment, one could clone this region, place any genes of interest at each end and introduce the construct into *Schizochytrium* (or some other host in which the promoters can be shown to function). It is predicted that the regulatory elements, under the appropriate conditions, would provide for coordinated, high level expression of the two introduced genes. The complete nucleotide sequence for the regulatory region containing *Schizochytrium* PUFA PKS regulatory elements (e.g., a promoter) is represented herein as SEQ ID NO:76.

In a similar manner, OrfC is highly expressed in *Schizochytrium* during the time of oil production and regulatory elements are expected to reside in the region upstream of its start codon. A region of genomic DNA upstream of OrfC has been cloned and sequenced and is represented herein as (SEQ ID NO:77). This sequence contains the 3886 nt immediately upstream of the OrfC start codon. Examination of this region did not reveal any obvious Orfs (i.e., no significant matches were found on a BlastX search). It is believed that regulatory elements contained in this region, under the appropriate conditions, will provide for high-level expression of a gene placed behind them. Additionally, under the appropriate conditions, the level of expression may be coordinated with genes under control of the A-B intergenic region (SEQ ID NO:76).

Therefore, in one embodiment, a recombinant nucleic acid molecule useful in the present invention, as disclosed herein, can include a PUFA PKS regulatory region contained within SEQ ID NO:76 and/or SEQ ID NO:77. Such a regulatory region can include any portion (fragment) of SEQ ID NO:76 and/or SEQ ID NO:77 that has at least basal PUFA PKS transcriptional activity (at least basal promoter activity).

One or more recombinant molecules of the present invention can be used to produce an encoded product (e.g., a PUFA PKS domain, protein, or system) of the present invention. In one embodiment, an encoded product is produced by expressing a nucleic acid molecule as described herein under conditions effective to produce the protein. A preferred method to produce an encoded protein is by transfecting a host cell with one or more recombinant molecules to form a recombinant cell. Suitable host cells to transfect include, but are not limited to, any bacterial, fungal (e.g., yeast), insect, plant or animal cell that can be transfected. Host cells can be either untransfected cells or cells that are already transfected with at least one other recombinant nucleic acid molecule.

According to the present invention, the term "transfection" is used to refer to any method by which an exogenous nucleic acid molecule (i.e., a recombinant nucleic acid molecule) can be inserted into a cell. The term "transformation" can be used interchangeably with the term "transfection" when such term is used to refer to the introduction of nucleic acid molecules into microbial cells, such as algae, bacteria and yeast. In microbial systems, the term "transformation" is used to describe an inherited change due to the acquisition of exogenous nucleic acids by the microorganism and is essentially synonymous with the term "transfection." However, in animal cells, transformation has acquired a second meaning which can refer to changes in the growth properties of cells in culture after they become cancerous, for example. Therefore, to avoid confusion, the term "transfection" is preferably used with regard to the introduction of exogenous nucleic acids into animal cells, and the term "transfection" will be used herein to generally encompass transfection of animal cells, plant cells and transformation of microbial cells, to the extent that the terms pertain to the introduction of exogenous nucleic acids into a cell. Therefore, transfection techniques include, but are not limited to, transformation, particle bombardment, electroporation, microinjection, lipofection, adsorption, infection and protoplast fusion.

It will be appreciated by one skilled in the art that use of recombinant DNA technologies can improve control of expression of transfected nucleic acid molecules by manipulating, for example, the number of copies of the nucleic acid molecules within the host cell, the efficiency with which those nucleic acid molecules are transcribed, the efficiency with which the resultant transcripts are translated, and the efficiency of post-translational modifications. Additionally, the promoter sequence might be genetically engineered to improve the level of expression as compared to the native promoter. Recombinant techniques useful for controlling the expression of nucleic acid molecules include, but are not limited to, integration of the nucleic acid molecules into one or more host cell chromosomes, addition of vector stability sequences to plasmids, substitutions or modifications of transcription control signals (e.g., promoters, operators, enhancers), substitutions or modifications of translational control signals (e.g., ribosome binding sites, Shine-Dalgarno sequences), modification of nucleic acid molecules to correspond to the codon usage of the host cell, and deletion of sequences that destabilize transcripts.

General discussion above with regard to recombinant nucleic acid molecules and transfection of host cells is intended to be applied to any recombinant nucleic acid molecule discussed herein, including those encoding any amino acid sequence having a biological activity of at least one domain from a PUFA PKS, those encoding amino acid sequences from other PKS systems, and those encoding other proteins or domains.

This invention also relates to PUFA PKS systems (and proteins or domains thereof) from microorganisms other than those described specifically herein that are homologous in structure, domain organization and/or function to any of the PUFA PKS system (and proteins or domains thereof) as described herein. In addition, this invention relates to use of these microorganisms and the PUFA PKS systems or components thereof (e.g., DH2 domains) from these microorganisms in the various applications for a PUFA PKS system (e.g., genetically modified organisms and methods of producing bioactive molecules) according to the present invention. A screening process for identification of microorganisms comprising a PUFA PKS system is described in detail in U.S. Patent Application Publication No. 20020194641, supra. The knowledge of the structure and function of the PUFA PKS proteins and domains described herein, and the nucleotide sequence encoding the same, are useful tools for the identification, confirmation, and/or isolation of homologues of such proteins or polynucleotides.

According to the present invention, the term "thraustochytrid" refers to any members of the order Thraustochytriales, which includes the family Thraustochytriaceae, and the term "labyrinthulid" refers to any member of the order Labyrinthulales, which includes the family Labyrinthulaceae. The members of the family Labyrinthulaceae were at one time considered to be members of the order Thraustochytriales, but in more recent revisions of the taxonomy of such organisms, the family is now considered to be a member of the order Labyrinthulales, and both Labyrinthulales and Thraustochytriales are considered to be members of the phylum Labyrinthulomycota. Developments have resulted in frequent revision of the taxonomy of the thraustochytrids and labyrinthulids. However, taxonomic theorists now generally place both of these groups of microorganisms with the algae or algae-like protists within the Stramenopile lineage. The current taxonomic placement of the thraustochytrids and labyrinthulids can be summarized as follows:

Realm: Stramenopila (Chromista)
   Phylum: Labyrinthulomycota
     Class: Labyrinthulomycetes
       Order: Labyrinthulales
         Family: Labyrinthulaceae
       Order: Thraustochytriales
         Family: Thraustochytriaceae However, because of remaining taxonomic uncertainties it would be best for the purposes of the present invention to consider the strains described in the present invention as thraustochytrids to include the following organisms: Order: Thraustochytriales; Family: Thraustochytriaceae; Genera: *Thraustochytrium* (Species: sp., *arudimentale, aureum, benthicola, globosum, kinnei, motivum, multirudimentale, pachydermum, proliferum, roseum, striatum*), *Ulkenia* (Species: sp., *amoeboidea, kerguelensis, minuta, profunda, radiata, sailens, sarkariana, schizochytrops, visurgensis, yorkensis*), *Schizochytrium* (Species: sp., *aggregatum, limnaceum, mangrovei, minutum, octosporum*), *Japonochytrium* (Species: sp., *marinum*), *Aplanochytrium* (Species: sp., *haliotidis, kerguelensis, profunda, stocchinoi*), *Althornia* (Species: sp., *crouchii*), or *Elina* (Species: sp., *marisalba, sinorifica*). It is to be noted that the original description of the genus *Ulkenia* was not published in a peer-reviewed journal so some questions remain as to the validity of this genus and the species placed within it. For the purposes of this invention, species described within *Ulkenia* will be considered to be members of the genus *Thraustochytrium*.

Strains described in the present invention as Labyrinthulids include the following organisms: Order: Labyrinthulales, Family: Labyrinthulaceae, Genera: *Labyrinthula* (Species: sp., *algeriensis, coenocystis, chattonii, macrocystis, macrocystis atlantica, macrocystis macrocystis, marina, minuta, roscoffensis, valkanovii, vitellina, vitellina pacifica, vitellina vitellina, zopfii*), *Labyrinthuloides* (Species: sp., *haliotidis, yorkensis*), *Labyrinthomyxa* (Species: sp., *marina*), *Diplophrys* (Species: sp., *archeri*), *Pyrrhosorus* (Species: sp., *marinus*), *Sorodiplophrys* (Species: sp., *stercorea*) or *Chlamydomyxa* (Species: sp., *labyrinthuloides, montana*) (although there is currently not a consensus on the exact taxonomic placement of *Pyrrhosorus, Sorodiplophrys* or *Chlamydomyxa*).

To produce significantly high yields of various bioactive molecules using the PUFA PKS system of the present invention, an organism, preferably a microorganism or a plant or plant part (e.g., a plant cell), can be genetically modified to affect the activity of a PUFA PKS system. In one aspect, such an organism can endogenously contain and express a PUFA PKS system, and the genetic modification can be a genetic modification of one or more of the functional domains of the endogenous PUFA PKS system, whereby the modification has some effect on the activity of the PUFA PKS system. In another aspect, such an organism can endogenously contain and express a PUFA PKS system, and the genetic modification can be an introduction of at least one exogenous nucleic acid sequence (e.g., a recombinant nucleic acid molecule), wherein the exogenous nucleic acid sequence encodes at least one biologically active domain or protein from the same or a second PKS system and/or a protein that affects the activity of said PUFA PKS system (e.g., a phosphopantetheinyl transferases (PPTase), discussed below). In yet another aspect, the organism does not necessarily endogenously (naturally) contain a PUFA PKS system, but is genetically modified to introduce at least one recombinant nucleic acid molecule encoding an amino acid sequence having the biological activity of at least one domain of a PUFA PKS system. In this aspect, PUFA PKS activity is affected by introducing or increasing PUFA PKS activity in the organism. Various embodiments associated with each of these aspects will be discussed in greater detail below.

Therefore, according to the present invention, one embodiment relates to a genetically modified microorganism, wherein the microorganism expresses a PKS system comprising at least one biologically active domain of a polyunsaturated fatty acid (PUFA) polyketide synthase (PKS) system. The at least one domain of the PUFA PKS system is encoded by a nucleic acid sequence described herein. The genetic modification affects the activity of the PKS system in the organism. The genetically modified microorganism can include any one or more of the above-identified nucleic acid sequences, and/or any of the other homologues of any of the PUFA PKS ORFs or domains as described in detail above.

As used herein, a genetically modified microorganism can include a genetically modified bacterium, protist, microalgae, fungus, or other microbe, and particularly, any of the genera of the order Thraustochytriales (e.g., a thraustochytrid) described herein. Such a genetically modified microorganism has a genome which is modified (i.e., mutated or changed) from its normal (i.e., wild-type or naturally occurring) form such that the desired result is achieved (i.e., increased or modified PUFA PKS activity and/or production of a desired product using the PUFA PKS system or component thereof). Genetic modification of a microorganism can be accomplished using classical strain development and/or molecular genetic techniques. Such techniques known in the art and are generally disclosed for microorganisms, for example, in Sambrook et al., 1989, *Molecular Cloning: A Laboratory*

*Manual*, Cold Spring Harbor Labs Press. The reference Sambrook et al., ibid., is incorporated by reference herein in its entirety. A genetically modified microorganism can include a microorganism in which nucleic acid molecules have been inserted, deleted or modified (i.e., mutated; e.g., by insertion, deletion, substitution, and/or inversion of nucleotides), in such a manner that such modifications provide the desired effect within the microorganism.

Preferred microorganism host cells to modify according to the present invention include, but are not limited to, any bacteria, protist, microalga, fungus, or protozoa. In one aspect, preferred microorganisms to genetically modify include, but are not limited to, any microorganism of the order Thraustochytriales or any microorganism of the order Labyrinthulales. Particularly preferred host cells for use in the present invention could include microorganisms from a genus including, but not limited to: *Thraustochytrium, Ulkenia, Schizochytrium, Japonochytrium, Aplanochytrium, Althornia, Elina, Labyrinthula, Labyrinthuloides, Labyrinthomyxa, Diplophrys, Pyrrhosorus, Sorodiplophrys* or *Chlamydomyxa*. Other examples of suitable host microorganisms for genetic modification include, but are not limited to, yeast including *Saccharomyces cerevisiae, Saccharomyces carlsbergensis*, or other yeast such as *Candida, Kluyveromyces*, or other fungi, for example, filamentous fungi such as *Aspergillus, Neurospora, Penicillium*, etc. Bacterial cells also may be used as hosts. This includes *Escherichia coli*, which can be useful in fermentation processes. Alternatively, a host such as a *Lactobacillus* species or *Bacillus* species can be used as a host.

Another embodiment of the present invention relates to a genetically modified plant or part of a plant (e.g., wherein the plant has been genetically modified to express a PUFA PKS system described herein), which includes at least the core PUFA PKS enzyme complex and, in one embodiment, at least one PUFA PKS accessory protein, (e.g., a PPTase), so that the plant produces PUFAs. Preferably, the plant is an oil seed plant, wherein the oil seeds or oil in the oil seeds contain PUFAs produced by the PUFA PKS system. Such oils contain a detectable amount of at least one target or primary PUFA that is the product of the PUFA PKS system. Plants are not known to endogenously contain a PUFA PKS system, and therefore, the PUFA PKS systems of the present invention represent an opportunity to produce plants with unique fatty acid production capabilities. It is a particularly preferred embodiment of the present invention to genetically engineer plants to produce one or more PUFAs in the same plant, including, EPA, DHA, DPA (n-3 and/or n-6), ARA, GLA, SDA and others. The present invention offers the ability to create any one of a number of "designer oils" in various ratios and forms.

Methods for the genetic engineering of plants are well known in the art. For instance, numerous methods for plant transformation have been developed, including biological and physical transformation protocols. See, for example, Miki et al., "Procedures for Introducing Foreign DNA into Plants" in *Methods in Plant Molecular Biology and Biotechnology*, Glick, B. R. and Thompson, J. E. Eds. (CRC Press, Inc., Boca Raton, 1993) pp. 67-88. In addition, vectors and in vitro culture methods for plant cell or tissue transformation and regeneration of plants are available. See, for example, Gruber et al., "Vectors for Plant Transformation" in *Methods in Plant Molecular Biology and Biotechnology*, Glick, B. R. and Thompson, J. E. Eds. (CRC Press, Inc., Boca Raton, 1993) pp. 89-119.

The most widely utilized method for introducing an expression vector into plants is based on the natural transformation system of *Agrobacterium*. See, for example, Horsch et al., *Science* 227:1229 (1985). *A. tumefaciens* and *A. rhizogenes* are plant pathogenic soil bacteria which genetically transform plant cells. The Ti and Ri plasmids of *A. tumefaciens* and *A. rhizogenes*, respectively, carry genes responsible for genetic transformation of the plant. See, for example, Kado, C. I., *Crit. Rev. Plant. Sci.* 10:1 (1991). Descriptions of *Agrobacterium* vector systems and methods for *Agrobacterium*-mediated gene transfer are provided by numerous references, including Gruber et al., supra, Miki et al., supra, Moloney et al., *Plant Cell Reports* 8:238 (1989), and U.S. Pat. Nos. 4,940,838 and 5,464,763.

Another generally applicable method of plant transformation is microprojectile-mediated transformation wherein DNA is carried on the surface of microprojectiles. The expression vector is introduced into plant tissues with a biolistic device that accelerates the microprojectiles to speeds sufficient to penetrate plant cell walls and membranes. Sanford et al., *Part. Sci. Technol.* 5:27 (1987), Sanford, J. C., *Trends Biotech.* 6:299 (1988), Sanford, J. C., *Physiol. Plant* 79:206 (1990), Klein et al., *Biotechnology* 10:268 (1992).

Another method for physical delivery of DNA to plants is sonication of target cells. Zhang et al., *Bio/Technology* 9:996 (1991). Alternatively, liposome or spheroplast fusion have been used to introduce expression vectors into plants. Deshayes et al., *EMBO J.*, 4:2731 (1985), Christou et al., *Proc Natl. Acad. Sci. USA* 84:3962 (1987). Direct uptake of DNA into protoplasts using $CaCl_2$ precipitation, polyvinyl alcohol or poly-L-ornithine have also been reported. Hain et al., *Mol. Gen. Genet.* 199:161 (1985) and Draper et al., *Plant Cell Physiol.* 23:451 (1982). Electroporation of protoplasts and whole cells and tissues have also been described. Donn et al., In Abstracts of VIIth International Congress on Plant Cell and Tissue Culture IAPTC, A2-38, p. 53 (1990); D'Halluin et al., *Plant Cell* 4:1495-1505 (1992) and Spencer et al., *Plant Mol. Biol.* 24:51-61 (1994).

Following the introduction of the genetic construct into plant cells, plant cells are grown and upon emergence of differentiating tissue such as shoots and roots, mature plants are generated. Typically a plurality of plants is generated. Methodologies for regenerating plants will be generally known to those skilled in the art and may be found in for example: Plant Cell and Tissue Culture, 1994, Vasil and Thorpe Eds. Kluwer Academic Publishers and in: *Plant Cell Culture Protocols* (Methods in Molecular Biology 111, 1999 Hall Eds Humana Press).

As used herein, a genetically modified plant can include any genetically modified plant including higher plants and particularly, any consumable plants or plants useful for producing a desired bioactive molecule of the present invention. "Plant parts", as used herein, include any parts of a plant, including, but not limited to, seeds (immature or mature), oils, pollen, embryos, flowers, fruits, shoots, leaves, roots, stems, explants, etc. A genetically modified plant has a genome that is modified (i.e., mutated or changed) from its normal (i.e., wild-type or naturally occurring) form such that the desired result is achieved (e.g., PUFA PKS activity and production of PUFAs). Genetic modification of a plant can be accomplished using classical strain development and/or molecular genetic techniques. Methods for producing a transgenic plant, wherein a recombinant nucleic acid molecule encoding a desired amino acid sequence is incorporated into the genome of the plant, are known in the art. A preferred plant to genetically modify according to the present invention is preferably a plant suitable for consumption by animals, including humans.

Preferred plants to genetically modify according to the present invention (i.e., plant host cells) include, but are not limited to any higher plants, including both dicotyledonous and monocotyledonous plants, and particularly consumable plants, including crop plants and especially plants used for their oils. Such plants can include, but are not limited to, for example: canola, soybeans, rapeseed, linseed, corn, safflowers, sunflowers and tobacco. Thus, any plant species or plant cell may be selected. Particular cells used herein, and plants grown or derived therefrom, include, but are not limited to, cells obtainable from canola (*Brassica rapa* L.); soybean (*Glycine max*); rapeseed (*Brassica* spp.); linseed/flax (*Linum usitatissimum*); maize (corn) (*Zea mays*); safflower (*Carthamus tinctorius*); sunflower (*Helianthus annuus*); tobacco (*Nicotiana tabacum*); *Arabidopsis thaliana*, Brazil nut (*Betholettia excelsa*); castor bean (*Riccinus communis*); coconut (*Cocus nucifera*); coriander (*Coriandrum sativum*); cotton (*Gossypium* spp.); groundnut (*Arachis hypogaea*); jojoba (*Simmondsia chinensis*); mustard (*Brassica* spp. and *Sinapis alba*); oil palm (*Elaeis guineeis*); olive (*Olea eurpaea*); rice (*Oryza sativa*); squash (*Cucurbita maxima*); barley (*Hordeum vulgare*); wheat (*Traeticum aestivum*); and duckweed (*Lemnaceae* sp.). It should be noted that in accordance herewith the genetic background within a plant species may vary.

Other preferred plants include those plants that are known to produce compounds used as pharmaceutical agents, flavoring agents, nutraceutical agents, functional food ingredients or cosmetically active agents or plants that are genetically engineered to produce these compounds/agents.

In a further embodiment plant cell cultures may be used in accordance herewith. In such embodiments plant cells are not grown into differentiated plants and cultivated using ordinary agricultural practices, but instead grown and maintained in a liquid medium.

According to the present invention, a genetically modified microorganism or plant includes a microorganism or plant that has been modified using recombinant technology. As used herein, genetic modifications that result in a decrease in gene expression, in the function of the gene, or in the function of the gene product (i.e., the protein encoded by the gene) can be referred to as inactivation (complete or partial), deletion, interruption, blockage or down-regulation of a gene. For example, a genetic modification in a gene which results in a decrease in the function of the protein encoded by such gene, can be the result of a complete deletion of the gene (i.e., the gene does not exist, and therefore the protein does not exist), a mutation in the gene which results in incomplete or no translation of the protein (e.g., the protein is not expressed), or a mutation in the gene which decreases or abolishes the natural function of the protein (e.g., a protein is expressed which has decreased or no enzymatic activity or action). Genetic modifications that result in an increase in gene expression or function can be referred to as amplification, overproduction, overexpression, activation, enhancement, addition, or up-regulation of a gene.

The genetic modification of a microorganism or plant according to the present invention preferably affects the activity of the PKS system expressed by the plant, whether the PKS system is endogenous and genetically modified, endogenous with the introduction of recombinant nucleic acid molecules into the organism, or provided completely by recombinant technology. According to the present invention, to "affect the activity of a PKS system" includes any genetic modification that causes any detectable or measurable change or modification in the PKS system expressed by the organism as compared to in the absence of the genetic modification. A detectable change or modification in the PKS system can include, but is not limited to: the introduction of PKS system activity into an organism such that the organism now has measurable/detectable PKS system activity (i.e., the organism did not contain a PKS system prior to the genetic modification), the introduction into the organism of a functional domain from a different PKS system than a PKS system endogenously expressed by the organism such that the PKS system activity is modified (e.g., DH2 domain from one PUFA PKS system is introduced into the PUFA PKS system of an different organism), a change in the amount of a bioactive molecule produced by the PKS system (e.g., the system produces more (increased amount) or less (decreased amount) of a given product as compared to in the absence of the genetic modification), a change in the type of a bioactive molecule produced by the PKS system (e.g., the system produces a new or different product, or a variant of a product that is naturally produced by the system), and/or a change in the ratio of multiple bioactive molecules produced by the PKS system (e.g., the system produces a different ratio of one PUFA to another PUFA, produces a completely different lipid profile as compared to in the absence of the genetic modification, or places various PUFAs in different positions in a triacylglycerol as compared to the natural configuration). Such a genetic modification includes any type of genetic modification and specifically includes modifications made by recombinant technology and by classical mutagenesis.

It should be noted that reference to increasing the activity of a functional domain or protein in a PUFA PKS system refers to any genetic modification in the organism containing the domain or protein (or into which the domain or protein is to be introduced) which results in increased functionality of the domain or protein system and can include higher activity of the domain or protein (e.g., specific activity or in vivo enzymatic activity), reduced inhibition or degradation of the domain or protein system, and overexpression of the domain or protein. For example, gene copy number can be increased, expression levels can be increased by use of a promoter that gives higher levels of expression than that of the native promoter, or a gene can be altered by genetic engineering or classical mutagenesis to increase the activity of the domain or protein encoded by the gene.

Similarly, reference to decreasing the activity of a functional domain or protein in a PUFA PKS system refers to any genetic modification in the organism containing such domain or protein (or into which the domain or protein is to be introduced) which results in decreased functionality of the domain or protein and includes decreased activity of the domain or protein, increased inhibition or degradation of the domain or protein and a reduction or elimination of expression of the domain or protein. For example, the action of a domain or protein of the present invention can be decreased by blocking or reducing the production of the domain or protein, "knocking out" the gene or portion thereof encoding the domain or protein, reducing domain or protein activity, or inhibiting the activity of the domain or protein. Blocking or reducing the production of a domain or protein can include placing the gene encoding the domain or protein under the control of a promoter that requires the presence of an inducing compound in the growth medium. By establishing conditions such that the inducer becomes depleted from the medium, the expression of the gene encoding the domain or protein (and therefore, of protein synthesis) could be turned off. Blocking or reducing the activity of domain or protein could also include using an excision technology approach similar to that described in U.S. Pat. No. 4,743,546, incorporated herein by reference. To use this approach, the gene encoding the protein of interest is cloned between specific genetic sequences that allow specific, controlled excision of the gene from the genome. Excision could be prompted by, for example, a shift in the cultivation temperature of the culture, as in U.S. Pat. No. 4,743,546, or by some other physical or nutritional signal.

In one embodiment of the present invention, a genetic modification includes a modification of a nucleic acid sequence encoding protein or domain of an endogenously (naturally) expressed PUFA PKS system, whereby a microorganism that naturally contains such a system is genetically modified by, for example, classical mutagenesis and selection techniques and/or molecular genetic techniques, include genetic engineering techniques. Genetic engineering techniques can include, for example, using a targeting recombinant vector to delete a portion of an endogenous gene, or to replace a portion of an endogenous gene with a heterologous sequence. Examples of heterologous sequences that could be introduced into a host genome include sequences encoding at least one functional domain from another PKS system, such as a different PUFA PKS system (bacterial or non-bacterial), a type I PKS system (iterative or modular), a type II PKS system, or a type III PKS system. Other heterologous sequences to introduce into the genome of a host includes a sequence encoding a protein or functional domain that is not a domain of a core PKS system, but which will affect the activity of the endogenous PKS system. For example, one could introduce into the host genome a nucleic acid molecule encoding a phosphopantetheinyl transferase (discussed below). Specific modifications that could be made to an endogenous PUFA PKS system are discussed in detail below.

In another aspect of this embodiment of the invention, the genetic modification includes: (1) the introduction into a homologous or heterologous host cell or organism of a recombinant nucleic acid molecule encoding an amino acid sequence having a biological activity of at least one domain of a PUFA PKS system; and/or (2) the introduction into a host cell or organism of a recombinant nucleic acid molecule encoding a protein or functional domain that affects the activity of a PUFA PKS system. The host can include: (1) a host cell or organism that does not express any PKS system for the production of PUFAs, wherein all functional domains of a PUFA PKS system are introduced into the host cell; (2) a host cell that expresses a PKS system for the production of PUFAs (endogenous or recombinant), wherein at least one additional PUFA PKS domain or protein is introduced into the cell or organism. In other words, the present invention intends to encompass any genetically modified cell or organism (e.g., microorganism or plant), wherein the organism comprises at least one PUFA PKS domain or protein described herein, or has been modified to produce a resynthesized and/or chimeric PUFA PKS domain or protein as described herein.

Therefore, using the guidance provided herein, as well as the description of the PUFA PKS systems described herein and known prior to the invention, gene mixing (or mixing of nucleic acid molecules), for example, by the production of chimeric proteins and/or chimeric PUFA PKS systems as described in detail herein, can be used to extend the range of PUFA products, ratios thereof, and production levels thereof, by an organism expressing the PUFA PKS system. For example, the teachings provided herein can be used to improve the amounts of PUFAs produced, to change the ratio of one PUFA to another, including the ratio of omega-3 to omega-6 PUFAs, and to extend the range of PUFA PKS products to include EPA, DPA (n-3 or n-6), DHA, ARA, GLA, SDA and others, as well as to produce a wide variety of bioactive molecules, including antibiotics, other pharmaceutical compounds, and other desirable products. The method to obtain these improvements includes not only the mixing of genes from various organisms but also various methods of genetically modifying the PUFA PKS genes and nucleic acid molecules disclosed herein. Knowledge of the genetic basis and domain structure of the PUFA PKS systems as described herein provides a basis for designing novel genetically modified organisms. By way of example, various possible manipulations of the PUFA PKS system are discussed in U.S. Patent Application Publication No. 20020194641, U.S. Patent Application Publication No. 20040235127, and U.S. Patent Application Publication No. 20050100995, supra with regard to genetic modification and bioactive molecule production. However, this invention provides novel embodiments regarding the manipulation of PUFA production levels by a host organism and the manipulation of the ratio of PUFAs produced by a host organism.

Accordingly, encompassed by the present invention are methods to genetically modify microbial or plant cells by: genetically modifying at least one nucleic acid sequence in the organism that encodes an amino acid sequence having the biological activity of at least one functional domain of a PUFA PKS system according to the present invention, and/or expressing at least one recombinant nucleic acid molecule comprising a nucleic acid sequence encoding such amino acid sequence. Various embodiments of such sequences, methods to genetically modify an organism, and specific modifications have been described in detail above. Typically, the method is used to produce a particular genetically modified organism that produces a particular bioactive molecule or molecules.

In one embodiment of the present invention, it is contemplated that a mutagenesis program could be combined with a selective screening process to obtain bioactive molecules of interest. This would include methods to search for a range of bioactive compounds. This search would not be restricted to production of those molecules with cis double bonds. The mutagenesis methods could include, but are not limited to: chemical mutagenesis, gene shuffling, switching regions of the genes encoding specific enzymatic domains, or mutagenesis restricted to specific regions of those genes, as well as other methods.

For example, high throughput mutagenesis methods could be used to influence or optimize production of the desired bioactive molecule. Once an effective model system has been developed, one could modify these genes in a high throughput manner. Utilization of these technologies can be envisioned on two levels. First, if a sufficiently selective screen for production of a product of interest (e.g., ARA) can be devised, it could be used to attempt to alter the system to produce this product (e.g., in lieu of, or in concert with, other strategies such as those discussed above). Additionally, if the strategies outlined above resulted in a set of genes that did produce the product of interest, the high throughput technologies could then be used to optimize the system. For example, if the introduced domain only functioned at relatively low temperatures, selection methods could be devised to permit removing that limitation.

It is recognized that many genetic alterations, either random or directed, which one may introduce into a native (endogenous, natural) PUFA PKS system, will result in an inactivation of enzymatic functions. A preferred embodiment of the invention includes a system to select for only those modifications that do not block the ability of the PUFA PKS system to produce a product. For example, the FabB-strain of *E. coli* is incapable of synthesizing unsaturated fatty acids and requires supplementation of the medium with fatty acids that can substitute for its normal unsaturated fatty acids in order to grow (see Metz et al., 2001, supra). However, this requirement (for supplementation of the medium) can be removed when the strain is transformed with a functional PUFA PKS system (i.e. one that produces a PUFA product in the *E. coli* host—see (Metz et al., 2001, supra, FIG. 2A). The transformed FabB-strain now requires a functional PUFA-PKS system (to produce the unsaturated fatty acids) for growth without supplementation. The key element in this example is that production of a wide range of unsaturated fatty acids will suffice (even unsaturated fatty acid substitutes, such as branched chain fatty acids). Therefore, in another preferred embodiment of the invention, one can create a large number of mutations in one or more of the PUFA PKS genes disclosed herein, and then transform the appropriately modified FabB-strain (e.g. create mutations in an expression construct containing an ER domain and transform a FabB-strain having the other essential domains on a separate plasmid—or integrated into the chromosome) and select only for those transformants that grow without supplementation of the medium (i.e., that still possessed an ability to produce a molecule that could complement the FabB-defect). Additional screens can be developed to look for particular compounds (e.g. use of GC for fatty acids) being produced in this selective subset of an active PKS system. One could envision a number of similar selective screens for bioactive molecules of interest.

In one embodiment of invention, a genetically modified organism has a modification that changes at least one product produced by the endogenous PKS system, as compared to a wild-type organism. Novel constructs used to produce such modified organisms, as well as the proteins and organisms produced using such constructs, and the methods associated with such modifications, are all encompassed by the invention.

In one preferred embodiment, a genetically modified organism expresses a PUFA PKS system comprising a genetic modification in a β-hydroxy acyl-ACP dehydrase (DH) domain corresponding to the DH2 domain of *Schizochytrium* or *Thraustochytrium*, wherein the modification alters the ratio of long chain fatty acids, and particularly, the ratio of omega-3 to omega-6 long chain fatty acids, produced by the PUFA PKS system, as compared to in the absence of the modification. In one aspect of this embodiment, the modification is selected from the group consisting of a deletion of all or a part of the domain, a substitution of all or part of the domain with a homologous domain or part thereof from a different organism (e.g., a different organism that naturally produces different ratios and/or amounts of PUFAs), and a mutation of the domain.

More specifically, as illustrated herein, the comparison of the *Schizochytrium* and *Thraustochytrium* PUFA PKS architecture (domain organization) with other PUFA PKS system architecture illustrates nature's ability to alter domain order as well as incorporate new domains to create novel end products, or alter the ratios of end products, for example. In addition, the genes can now be manipulated in the laboratory to create new products, as described in the Examples. The inventors have now demonstrated the ability to harness this ability and use it to create novel organisms with novel PUFA profiles and production amounts. Described herein is the manipulation of PUFA PKS systems in either a directed or random manner to influence the end products. For example, in a preferred embodiment, substitution of a DH (FabA-like) domain or biologically active portion thereof of a first PUFA PKS system, and specifically, the DH2 domain described herein, for the homologous DH domain or biologically active portion thereof in a different, second PUFA PKS system is used to alter the ratio of PUFAs produced by the second PUFA PKS system, and particularly, to manipulate the ratio of omega-3 to omega-6 fatty acids produced by the second PUFA PKS system. A similar result can be achieved by substituting an entire protein or any biologically active portion thereof containing such DH2 domain (e.g., OrfC from *Thraustochytrium* 23B) from a first PUFA PKS system for the homologous protein or portion thereof in a second PUFA PKS system. While the examples described herein utilize the PUFA PKS systems from *Schizochytrium* and *Thraustochytrium*, the similar manipulation of any PKS or PKS-like system for the production of PUFAs by modification of the DH2 protein or DH2-like domain is encompassed by the invention. Such modification can be performed alone or in conjunction with other modifications to a PUFA PKS system.

Accordingly, one embodiment of the present invention comprises a chimeric PUFA PKS system and an organism expressing such chimeric PUFA PKS system. In one aspect, the chimeric PUFA PKS system comprises a first PUFA PKS system, wherein the domain or protein of the first PUFA PKS system that corresponds to the DH2 domain or biologically active portion thereof (e.g., from *Schizochytrium* or *Thraustochytrium* described herein) has been modified or substituted with a DH2 domain or protein or biologically active portion thereof from a second, different PUFA PKS system. By "different PUFA PKS system" is meant a PUFA PKS system from a different strain, species, genus or organism, or even a homologue of a natural or wild-type PUFA PKS system. The goal of producing this chimeric protein is to alter the ratio of PUFAs, and particularly the ratio of omega-3 to omega-6 PUFAS, produced by the PUFA PKS system. Therefore, the selection of the different PUFA PKS system should be based on the selection of a second system producing a different, or desired, ratio of PUFAs than the first PUFA PKS system.

In one aspect of the invention, such a chimeric PUFA PKS system comprises a *Schizochytrium* OrfA (SEQ ID NO:2) and OrfB (SEQ ID NO:4) protein as described herein, and a *Thraustochytrium* OrfC (SEQ ID NO:62) protein as described herein. *Schizochytrium*, *E. coli*, and yeast organisms expressing such chimeric PUFA PKS systems are described in the Examples and are encompassed by the present invention, in addition to plants and plant parts expressing such chimeric PUFA PKS systems. In other embodiments, exemplified in the Examples, chimeric PUFA PKS systems are produced comprising all combinations of the *Schizochytrium* and *Thraustochytrium* OrfsA, B and C.

In another aspect of the invention, a chimeric PUFA PKS system comprises a *Schizochytrium* OrfA (SEQ ID NO:2) and OrfB (SEQ ID NO:4) protein as described herein, and a chimeric OrfC protein (encoded by a nucleic acid sequence represented herein by SEQ ID NO:74, encoded by SEQ ID NO:73). The chimeric OrfC polypeptide is 1493 amino acid residues in length. The DH2 region, defined as amino acids 516-1041 of SEQ ID NO:74, consists of the amino acid sequence of the DH2 region of the Th.23B OrfC protein, that is, amino acids 491-1016 of SEQ ID NO:62, which includes all of SEQ ID NO:66 and some flanking amino acid sequence from SEQ ID NO:62. With respect to the remainder of the chimeric OrfC amino acid sequence, residues 1-515 and 1042-1493 of SEQ ID NO:74 are identical to *Schizochytrium* OrfC residues 1-515 and 1051-1502 of SEQ ID NO:6, respectively.

In another embodiment of the invention, a genetically modified cell or organism has been modified to express a PUFA PKS system or portion thereof, including a chimeric PUFA PKS system, wherein the nucleic acid sequence(s) encoding the PUFA PKS system or portion thereof is optimized entirely or in part to utilize the preferred codon usage of the host cell or organism. This embodiment is exemplified below and illustrates how production of a bioactive molecule (e.g., a PUFA) can be increased by making such modifications. This embodiment can be utilized together with the other genetic modifications described herein (e.g., the chimeric PUFA PKS and protein embodiments), to improve production of a bioactive molecule in a host organism.

In one aspect of this embodiment, a chimeric PUFA PKS system comprises a *Schizochytrium* OrfA (SEQ ID NO:2) and OrfB (SEQ ID NO:4) protein as described herein, and a *Thraustochytrium* OrfC (SEQ ID NO:62) protein as described herein, wherein the nucleic acid sequence encoding SEQ ID NO:62 is optimized for the host codon usage. An example of such molecule optimized for expression in *Schizochytrium* is described in the Examples, with such nucleic acid sequence encoding *Thraustochytrium* OrfC (synthetic, or codon-optimized, OrfC) represented herein by SEQ ID NO:70. In another embodiment, *Thraustochytrium* OrfA (SEQ ID NO:39) and/or *Thraustochytrium* OrfB (SEQ ID NO:52) can be combined with any one or more of the *Schizochytrium* OrfsA, B, and/or C, and/or with the *Thraustochytrium* OrfC, for expression in *Schizochytrium*. Again, in this example, the nucleic acid molecule encoding the *Thraustochytrium* OrfA and/or *Thraustochytrium* OrfB can be optimized for the host codon usage. Examples of such molecules optimized for expression in *Schizochytrium* are described in the Examples, with the nucleic acid sequence encoding *Thraustochytrium* OrfA (synthetic, or codon-optimized, OrfA) represented herein by SEQ ID NO:71, and with the nucleic acid sequence encoding *Thraustochytrium* OrfB (synthetic, or codon-optimized, OrfB) represented herein by SEQ ID NO:72.

In another aspect of this embodiment, a chimeric PUFA PKS system comprises a *Schizochytrium* OrfA (SEQ ID NO:2) and OrfB (SEQ ID NO:4) protein as described herein, and a chimeric, and partially codon-optimized OrfC protein (encoded by a nucleic acid sequence represented herein by SEQ ID NO:75). The protein encoded by SEQ ID NO:75 is also represented by SEQ ID NO:74, which is described above with respect to SEQ ID NO:73. In this case, however, the portion of the nucleic acid sequence encoding SEQ ID NO:66 (DH2 domain), which is derived from *Thraustochytrium*, is optimized for expression in *Schizochytrium* as described in the Examples.

Other codon-optimized nucleic acid sequences for use in *E. coli*, yeast and plants are described above and below in the Examples.

In another embodiment, a genetically modified organism has been modified by transfecting the organism with a recombinant nucleic acid molecule encoding a protein that regulates the chain length of fatty acids produced by the PUFA PKS system. For example, the protein that regulates the chain length of fatty acids produced by the PUFA PKS system can be a chain length factor that directs the synthesis of C20 units and/or C22 units.

In another embodiment, a genetically modified organism expresses a PUFA PKS system comprising a modification in an enoyl-ACP reductase (ER) domain, wherein the modification results in the production of a different compound as compared to in the absence of the modification. In one aspect of this embodiment, the modification is selected from the group consisting of a deletion of all or a part of an ER domain, a substitution of an ER domain from a different organism for the ER domain, and a mutation of an ER domain.

In one embodiment of the invention, the genetically modified organism produces a polyunsaturated fatty acid (PUFA) profile that differs from the naturally occurring organism without a genetic modification.

Many other genetic modifications useful for producing bioactive molecules will be apparent to those of skill in the art, given the present disclosure, and various other modifications have been discussed previously herein. The present invention contemplates any genetic modification related to a PUFA PKS system as described herein which results in the production of a desired bioactive molecule.

As described above, in one embodiment of the present invention, a genetically modified organism, such as a genetically modified microorganism or plant, includes an organism which has an enhanced ability to synthesize desired bioactive molecules (products) or which has a newly introduced ability to synthesize specific products (e.g., to synthesize PUFAs, to synthesize a different profile of PUFAs, or to synthesize a specific antibiotic). According to the present invention, "an enhanced ability to synthesize" a product refers to any enhancement, or up-regulation, in a pathway related to the synthesis of the product such that the microorganism or plant produces an increased amount of the product (including any production of a product where there was none before) as compared to the wild-type microorganism or plant, cultured or grown, under the same conditions. Methods to produce such genetically modified organisms have been described in detail above. In one preferred embodiment, the present invention relates to a genetically modified plant or part of a plant (e.g., wherein the plant has been genetically modified to express a PUFA PKS system, including a chimeric PUFA PKS system, described herein), which includes at least the core PUFA PKS enzyme complex and, in one embodiment, at least one PUFA PKS accessory protein, (e.g., a PPTase), so that the plant produces PUFAs. Preferably, the plant is an oil seed plant, wherein the oil seeds or oil in the oil seeds contain PUFAs produced by the PUFA PKS system. Such oils contain a detectable amount of at least one target or primary PUFA that is the product of the PUFA PKS system.

The present inventors have demonstrated the production of PUFAs in a plant that has been genetically modified to express the genes encoding a PUFA PKS system from *Schizochytrium* and a PUFA PKS accessory enzyme, 4'-phosphopantetheinyl transferase (PPTase) (e.g., see U.S. Patent Application Publication No. 20070089199, supra). The oils produced by these plants contain significant quantities of both DHA (docosahexaenoic acid (C22:6, n-3)) and DPA (docosapentaenoic acid (C22:5, n-6), which are the predominant PUFAs (the primary PUFAs) produced by the *Schizochytrium* from which the PUFA PKS genes were derived. Significantly, oils from plants that produce PUFAs using the PUFA PKS pathway have a different fatty acid profile than plants that are genetically engineered to produce the same PUFAs by the "standard" pathway described above. In particular, oils from plants that have been genetically engineered to produce specific PUFAs by the PUFA PKS pathway are substantially free of the various intermediate products and side products that accumulate in oils that are produced as a result of the use of the standard PUFA synthesis pathway. This characteristic is discussed in detail below.

More particularly, efforts to produce long chain PUFAs in plants by the "standard" pathway (described above) have taken the same basic approach, which is dictated by this synthesis pathway. These efforts relied on modification of the plants' endogenous fatty acids by introduction of genes encoding various elongases and desaturases. Plants typically produce 18 carbon fatty acids (e.g., oleic acid, linoleic acid, linolenic acid) via the Type II fatty acid synthase (FAS) in its plastids. Often, a single double bond is formed while that fatty acid is attached to ACP, and then the oleic acid (18:1) is cleaved from the ACP by the action of an acyl-ACP thioesterase. The free fatty acid is exported from the plastid and converted to an acyl-CoA. The 18:1 can be esterified to phosphatidylcholine (PC) and up to two more cis double bonds can be added. The newly introduced elongases can utilize substrates in the acyl-CoA pool to add carbons in two-carbon increments. Newly introduced desaturases can utilize either fatty acids esterified to PC, or those in the acyl-CoA pool, depending on the source of the enzyme. One consequence of this scheme for long chain PUFA production, however, is that intermediates or side products in the pathway accumulate, which often represent the majority of the novel fatty acids in the plant oil, rather than the target long chain PUFA.

For example, using the standard or classical pathway as described above, when the target PUFA product (i.e., the PUFA product that one is targeting for production, trying to produce, attempting to produce, by using the standard pathway) is DHA or EPA, for example (e.g., produced using elongases and desaturases that will produce the DHA or EPA from the products of the FAS system), a variety of intermediate products and side products will be produced in addition to the DHA or EPA, and these intermediate or side products frequently represent the majority of the products produced by the pathway, or are at least present in significant amounts in the lipids of the production organism. Such intermediate and side products include, but are not limited to, fatty acids having fewer carbons and/or fewer double bonds than the target, or primary PUFA, and can include unusual fatty acid side products that may have the same number of carbons as the target or primary PUFA, but which may have double bonds in unusual positions. By way of example, in the production of EPA using the standard pathway (e.g., see U.S. Patent Application Publication 2004/0172682), while the target PUFA of the pathway is EPA (i.e., due to the use of elongases and desaturases that specifically act on the products of the FAS system to produce EPA), the oils produced by the system include a variety of intermediate and side products including: gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9) and various other intermediate or side products, such as 20:0; 20:1 ($\Delta 5$); 20:1 ($\Delta 11$); 20:2 ($\Delta 8,11$); 20:2 ($\Delta 11,14$); 20:3 ($\Delta 5,11,14$); 20:3 ($\Delta 11,14,17$); mead acid (20:3; $\Delta 5,8,11$); or 20:4 ($\Delta 5,1,14,17$). Intermediates of the system can also include long chain PUFAs that are not the target of the genetic modification (e.g., a standard pathway enzyme system for producing DHA can actually produce more EPA as an intermediate product than DHA).

In contrast, the PUFA PKS synthase of the present invention does not utilize the fatty acid products of FAS systems. Instead, it produces the final PUFA product (the primary PUFA product) from the same small precursor molecule that is utilized by FASs and elongases (malonyl-CoA). Therefore, intermediates in the synthesis cycle are not released in any significant amount, and the PUFA product (also referred to herein as the primary PUFA product) is efficiently transferred to phospholipids (PL) and triacylglycerol (TAG) fractions of the lipids. Indeed, a PUFA PKS system may produce two target or primary PUFA products (e.g., the PUFA PKS system from *Schizochytrium* produces both DHA and DPAn-6 as primary products), but DPA is not an intermediate in the pathway to produce DHA. Rather, each is a separate product of the same PUFA PKS system. Therefore, the PUFA PKS genes of the present invention are an excellent means of producing oils containing PUFAs, and particularly, LCPUFAs in a heterologous host, such as a plant, wherein the oils are substantially free (defined below) of the intermediates and side products that contaminate oils produced by the "standard" PUFA pathway.

Therefore, it is an object of the present invention to produce, via the genetic manipulation of plants as described herein, polyunsaturated fatty acids and, by extension, oils obtained from such plants (e.g., obtained from the oil seeds of such plants) comprising these PUFAs. Examples of PUFAs that can be produced by the present invention include, but are not limited to, DHA (docosahexaenoic acid (C22:6, n-3)), ARA (eicosatetraenoic acid or arachidonic acid (C20:4, n-6)), DPA (docosapentaenoic acid (C22:5, n-6 or n-3)), and EPA (eicosapentaenoic acid (C20:5, n-3)). The present invention allows for the production of commercially valuable lipids enriched in one or more desired (target or primary) PUFAs by the present inventors' development of genetically modified plants through the use of the polyketide synthase system of the present invention, as well as components thereof, that produces PUFAs.

According to the present invention, reference to a "primary PUFA", "target PUFA", "intended PUFA", or "desired PUFA" refers to the particular PUFA or PUFAs that are the intended or targeted product of the enzyme pathway that is used to produce the PUFA(s). For example, when using elongases and desaturases to modify products of the FAS system, one can select particular combinations of elongases and desaturases that, when used together, will produce a target or desired PUFA (e.g., DHA or EPA). As discussed above, such target or desired PUFA produced by the standard pathway may not actually be a "primary" PUFA in terms of the amount of PUFA as a percentage of total fatty acids produced by the system, due to the formation of intermediates and side products that can actually represent the majority of products produced by the system. However, one may use the term "primary PUFA" even in that instance to refer to the target or intended PUFA product produced by the elongases or desaturases used in the system.

When using a PUFA PKS system as preferred in the present invention, a given PUFA PKS system derived from a particular organism will produce particular PUFA(s), such that selection of a PUFA PKS system from a particular organism will result in the production of specified target or primary PUFAs. For example, use of a PUFA PKS system from *Schizochytrium* will result in the production of DHA and DPAn-6 as the target or primary PUFAs. Use of a PUFA PKS system from various *Shewanella* species, on the other hand, will result in the production of EPA as the target or primary PUFA. It is noted that the ratio of the primary or target PUFAs can differ depending on the selection of the particular PUFA PKS system and on how that system responds to the specific conditions in which it is expressed. For example, use of a PUFA PKS system from *Thraustochytrium* 23B (ATCC No. 20892) will also result in the production of DHA and DPAn-6 as the target or primary PUFAs; however, in the case of *Thraustochytrium* 23B, the ratio of DHA to DPAn-6 is about 10:1 (and can range from about 8:1 to about 40:1), whereas in *Schizochytrium*, the ratio is typically about 2.5:1. Therefore, use of a *Thraustochytrium* PUFA PKS system or proteins or domains can alter the ratio of PUFAs produced by an organism as compared to *Schizochytrium* even though the target PUFAs are the same. However, as in detail above, the use of various proteins and domains with proteins and domains from other PUFA PKS systems or other PKS systems (that produce bioactive molecules other than PUFAs) can be combined ("mixed and matched") to produce chimeric proteins and/or chimeric PUFA PKS systems (described above), resulting in the production of different PUFA profiles, including different PUFA types, amounts, and/or ratios of one PUFA to another.

When using a PUFA PKS system of the present invention, oils produced by the organism, such as a plant, are substantially free of intermediate or side products that are not the target or primary PUFA products and that are not naturally produced by the endogenous FAS system in the wild-type organism (e.g., wild-type plants produce some shorter or medium chain PUFAs, such as 18 carbon PUFAs, via the FAS system, but there will be new, or additional, fatty acids produced in the plant as a result of genetic modification with a PUFA PKS system). In other words, as compared to the profile of total fatty acids from the wild-type plant (not genetically modified) or the parent plant used as a recipient for the indicated genetic modification, the majority of additional fatty acids in the profile of total fatty acids produced by plants that have been genetically modified with the PUFA PKS system of the present invention (or a component thereof), comprise the target or intended PUFA products of the PUFA PKS system (i.e., the majority of additional fatty acids in the total fatty acids that are produced by the genetically modified plant are the target PUFA(s)).

According to the present invention, reference to "intermediate products" or "side products" of an enzyme system that produces PUFAs refers to any products, and particularly, fatty acid products, that are produced by the enzyme system as a result of the production of the target or primary PUFA(s) of the system, but which are not the primary or target PUFA(s). In one embodiment, intermediate and side products may include non-target fatty acids that are naturally produced by the wild-type plant, or by the parent plant used as a recipient for the indicated genetic modification, but are now classified as intermediate or side products because they are produced in greater levels as a result of the genetic modification, as compared to the levels produced by the wild-type plant, or by the parent plant used as a recipient for the indicated genetic modification. Intermediate and side products are particularly significant in the standard pathway for PUFA synthesis and are substantially less significant in the PUFA PKS pathway, as discussed above. It is noted that a primary or target PUFA of one enzyme system may be an intermediate of a different enzyme system where the primary or target product is a different PUFA, and this is particularly true of products of the standard pathway of PUFA production, since the PUFA PKS system substantially avoids the production of intermediates. For example, when using the standard pathway to produce EPA, fatty acids such as GLA, DGLA and SDA are produced as intermediate products in significant quantities (e.g., U.S. Patent Application Publication 2004/0172682 illustrates this point). Similarly, and also illustrated by U.S. Patent Application Publication 2004/0172682, when using the standard pathway to produce DHA, in addition to the fatty acids mentioned above, ETA and EPA (notably the target PUFA in the first example above) are produced in significant quantities and in fact, may be present in significantly greater quantities relative to the total fatty acid product than the target PUFA itself. This latter point is also shown in U.S. Patent Application Publication 2004/0172682, where a plant that was engineered to produce DHA by the standard pathway produces more EPA as a percentage of total fatty acids than the targeted DHA.

Furthermore, to be "substantially free" of intermediate or side products of the system for synthesizing PUFAs, or to not have intermediate or side products present in substantial amounts, means that any intermediate or side product fatty acids (non-target PUFAs) that are produced in the genetically modified plant (and/or parts of plants and/or seed oil fraction) as a result of the introduction or presence of the enzyme system for producing PUFAs (i.e., that are not produced by the wild-type plant or the parent plant used as a recipient for the indicated genetic modification), are present in a quantity that is less than about 10% by weight of the total fatty acids produced by the plant, and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% by weight of the total fatty acids produced by the plant, and more preferably less than about 0.5% by weight of the total fatty acids produced by the plant.

In a preferred embodiment, to be "substantially free" of intermediate or side products of the system for synthesizing PUFAs, or to not have intermediate or side products present in substantial amounts, means that any intermediate or side product fatty acids that are produced in the genetically modified plant (and/or parts of plants and/or in seed oil fraction) as a result of the enzyme system for producing PUFAS (i.e., that are not produced by the wild-type plant or by the parent plant used as a recipient for the indicated genetic modification for production of target PUFAs), are present in a quantity that is less than about 10% by weight of the total additional fatty acids produced by the plant (additional fatty acids being defined as those fatty acids or levels of fatty acids that are not naturally produced by the wild-type plant or by the parent plant that is used as a recipient for the indicated genetic modification for production of target PUFAs), and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% of the total additional fatty acids produced by the plant. Therefore, in contrast to the fatty acid profile of plants that have been genetically modified to produce PUFAs via the standard pathway, the majority of fatty acid products resulting from the genetic modification with a PUFA PKS system will be the target or intended fatty acid products.

When the target product of a PUFA PKS system is a long chain PUFA, such as DHA or DPA (n-6 or n-3) produced by the PUFA PKS system of the invention described herein, intermediate products and side products that are not present in substantial amounts in the total lipids of plants genetically modified with such PUFA PKS can include, but are not limited to: gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9) and various other intermediate or side products, such as 20:0; 20:1 ($\Delta 5$); 20:1 ($\Delta 11$); 20:2 ($\Delta 8,11$); 20:2 ($\Delta 11,14$); 20:3 ($\Delta 5,11,14$); 20:3 ($\Delta 11,14,17$); mead acid (20:3; $\Delta 5,8,11$); or 20:4 ($\Delta 5,1,14,17$). In addition, when the target product is a particular PUFA, such as DHA, the intermediate products and side products that are not present in substantial amounts in the total lipids of the genetically modified plants also include other PUFAs, including other PUFAs that are a natural product of a different PUFA PKS system, such as EPA in this example. In some systems, a PUFA PKS system may make more than one PUFA, such as both a C22 and a C20 PUFA, and such combinations of PUFA may represent the target product, while other PUFAs may represent intermediate or side products. It is to be noted that the PUFA PKS system of the present invention can also be used, if desired, to produce as a target PUFA a PUFA that can include GLA, SDA or DGLA (referring to embodiments where oils are produced using components of a PUFA PKS system described herein).

Using the knowledge of the genetic basis and domain structure of the PUFA PKS system described herein, the present inventors have designed and produced constructs encoding such a PUFA PKS system and have successfully produced transgenic plants expressing the PUFA PKS system. The transgenic plants produce oils containing PUFAs, and the oils are substantially free of intermediate products that accumulate in a standard PUFA pathway (see U.S. Patent Application Publication No. 20070089199, supra). The present inventors have also demonstrated the use of the constructs to produce PUFAs in *E. coli*, and also in another eukaryote, yeast, as a proof-of-concept experiment prior to the production of the transgenic plants (U.S. Patent Application Publication No. 20070089199, supra). The examples demonstrate that transformation of both yeast and plants with a PUFA PKS system that produces DHA and DPAn-6 as the target PUFAs produces both of these PUFAs as the primary additional fatty acids in the total fatty acids of the plant (i.e., subtracting fatty acids that are produced in the wild-type plant), and in the yeast and further, that any other fatty acids that are not present in the fatty acids of the wild-type plant are virtually undetectable. Specific characteristics of genetically modified plants and parts and oils thereof of the present invention are described in detail elsewhere herein.

Accordingly, one embodiment of the present invention is a method to produce desired bioactive molecules (also referred to as products or compounds) by growing or culturing a genetically modified microorganism or a genetically modified plant of the present invention (described in detail above). Such a method includes the step of culturing in a growth or fermentation medium or growing in a suitable environment, such as soil, a microorganism or plant, respectively, that has a genetic modification as described previously herein and in accordance with the present invention. In a preferred embodiment, the method to produce bioactive molecules of the present invention includes the step of culturing under conditions effective to produce the bioactive molecule a genetically modified organism that expresses a PKS system comprising at least one biologically active domain of a polyunsaturated fatty acid (PUFA) polyketide synthase (PKS) system as described herein.

In the method of production of desired bioactive compounds of the present invention, a genetically modified microorganism is cultured or grown in a suitable medium, under conditions effective to produce the bioactive compound. An appropriate, or effective, medium refers to any medium in which a genetically modified microorganism of the present invention, when cultured, is capable of producing the desired product. Such a medium is typically an aqueous medium comprising assimilable carbon, nitrogen and phosphate sources. Such a medium can also include appropriate salts, minerals, metals and other nutrients. Microorganisms of the present invention can be cultured in conventional fermentation bioreactors. The microorganisms can be cultured by any fermentation process which includes, but is not limited to, batch, fed-batch, cell recycle, and continuous fermentation. Preferred growth conditions for potential host microorganisms according to the present invention are well known in the art. The desired bioactive molecules produced by the genetically modified microorganism can be recovered from the fermentation medium using conventional separation and purification techniques. For example, the fermentation medium can be filtered or centrifuged to remove microorganisms, cell debris and other particulate matter, and the product can be recovered from the cell-free supernatant by conventional methods, such as, for example, ion exchange, chromatography, extraction, solvent extraction, membrane separation, electrodialysis, reverse osmosis, distillation, chemical derivatization and crystallization. Alternatively, microorganisms producing the desired compound, or extracts and various fractions thereof, can be used without removal of the microorganism components from the product.

In the method for production of desired bioactive compounds of the present invention, a genetically modified plant or plant part (including a plant cell) is cultured in a growth medium or grown in a suitable medium such as soil, as appropriate. An appropriate, or effective, growth or culture medium has been discussed in detail above. A suitable growth medium for higher plants includes any growth medium for plants, including, but not limited to, soil, sand, any other particulate media that support root growth (e.g. vermiculite, perlite, etc.) or Hydroponic culture, as well as suitable light, water and nutritional supplements which optimize the growth of the higher plant. The genetically modified plants of the present invention are engineered to produce significant quantities of the desired product through the activity of the PUFA PKS system that is genetically modified according to the present invention. The compounds can be recovered through purification processes which extract the compounds from the plant. In a preferred embodiment, the compound is recovered by harvesting the plant. In a particularly preferred embodiment, PUFAs are recovered from the plant or plant part by harvesting the oil from the plant or plant part (e.g., from the oil seeds). In this embodiment, the plant can be consumed in its natural state or further processed into consumable products.

Bioactive molecules, according to the present invention, include any molecules (compounds, products, etc.) that have a biological activity, and that can be produced by a PKS system that comprises at least one amino acid sequence having a biological activity of at least one functional domain of a non-bacterial PUFA PKS system as described herein. Such bioactive molecules can include, but are not limited to: a polyunsaturated fatty acid (PUFA), an anti-inflammatory formulation, a chemotherapeutic agent, an active excipient, an osteoporosis drug, an anti-depressant, an anti-convulsant, an anti-Heliobactor pylori drug, a drug for treatment of neurodegenerative disease, a drug for treatment of degenerative liver disease, an antibiotic, and a cholesterol lowering formulation. One advantage of the non-bacterial PUFA PKS system of the present invention is the ability of such a system to introduce carbon-carbon double bonds in the cis configuration, and molecules including a double bond at every third carbon. This ability can be utilized to produce a variety of compounds.

With respect to microorganisms, preferably, bioactive compounds of interest are produced by the genetically modified microorganism in an amount that is greater than about 0.05%, and preferably greater than about 0.1%, and more preferably greater than about 0.25%, and more preferably greater than about 0.5%, and more preferably greater than about 0.75%, and more preferably greater than about 1%, and more preferably greater than about 2.5%, and more preferably greater than about 5%, and more preferably greater than about 10%, and more preferably greater than about 15%, and even more preferably greater than about 20% of the dry weight of the microorganism. For lipid compounds, preferably, such compounds are produced in an amount that is greater than about 5% of the dry weight of the microorganism. Other bioactive compounds, such as antibiotics or compounds that are synthesized in smaller amounts may be produced in quantities known to those of skill in the art, and those strains possessing such compounds are identified as predictably containing a novel PKS system of the type described herein.

In some embodiments, particular bioactive molecules (compounds) are secreted by the microorganism, rather than accumulating in the cells. Therefore, such bioactive molecules are generally recovered from the culture medium and the concentration of the molecule produced will vary depending on the microorganism and the size of the culture, and may be measured in g/L, rather than by dry cell weight.

Preferably, a genetically modified organism (e.g., microorganism or plant) of the invention produces one or more polyunsaturated fatty acids including, but not limited to, EPA (C20:5, n-3), DHA (C22:6, n-3), DPA (C22:5, n-6 or n-3), ARA (C20:4, n-6), GLA (C18:3, n-6), ALA (C18:3, n-3), and/or SDA (C18:4, n-3)), and more preferably, one or more long chain fatty acids (LCPUFAs), including, but not limited to, EPA (C20:5, n-3), DHA (C22:6, n-3), DPA (C22:5, n-6 or n-3), or DTA (C22:4, n-6). In a particularly preferred embodiment, a genetically modified organism of the invention produces one or more polyunsaturated fatty acids including, but not limited to, EPA (C20:5, n-3), DHA (C22:6, n-3), and/or DPA (C22:5, n-6 or n-3).

Preferably, a genetically modified organism of the invention produces at least one PUFA (the target PUFA), wherein the total fatty acid profile in the organism (or a part of the organism that accumulates PUFAs, such as mature seeds or oil from such seeds, if the organism is an oil seed plant), comprises a detectable amount of this PUFA or PUFAs. Preferably, the PUFA is at least a 20 carbon PUFA and comprises at least 3 double bonds, and more preferably at least 4 double bonds, and even more preferably, at least 5 double bonds. In one embodiment, the PUFA is a PUFA that is not naturally produced by the organism in detectable or significant quantities (e.g., the wild-type organism in the absence of genetic modification, or the parent organism used as a recipient for the indicated genetic modification).

Preferably, the total fatty acid profile in the organism (or part of the organism that accumulates PUFAs) comprises at least 0.1% of the target PUFA(s) by weight of the total fatty acids, and more preferably at least about 0.2%, and more preferably at least about 0.3%, and more preferably at least about 0.4%, and more preferably at least about 0.5%, and more preferably at least about 1%, and more preferably at least about 2%, and more preferably at least about 3%, and more preferably at least about 4%, and more preferably at least about 5%, and more preferably at least about 10%, and more preferably at least about 15%, and more preferably at least about 20%, and more preferably at least about 25%, and more preferably at least about 30%, and more preferably at least about 35%, and more preferably at least about 40%, and more preferably at least about 45%, and more preferably at least about 50%, and more preferably at least about 55%, and more preferably at least about 60%, and more preferably at least about 65%, and more preferably at least about 70%, and more preferably at least about 75%, and more preferably more that 75% of at least one polyunsaturated fatty acid (the target PUFA) by weight of the total fatty acids, or any percentage from 0.1% to 75%, or greater than 75% (up to 100% or about 100%), in 0.1% increments, of the target PUFA(s). As generally used herein, reference to a percentage amount of PUFA production is by weight of the total fatty acids produced by the organism, unless otherwise stated (e.g., in some cases, percentage by weight is relative to the total fatty acids produced by an enzyme complex, such as a PUFA PKS system). In one embodiment, total fatty acids produced by a plant are presented as a weight percent as determined by gas chromatography (GC) analysis of a fatty acid methyl ester (FAME) preparation.

As described above, it is an additional characteristic of the total fatty acids produced by the above-described plant (and/or parts of plants or seed oil fraction) that these total fatty acids produced by the plant comprise less than (or do not contain any more than) about 10% by weight of any fatty acids, other than the target PUFA(s) that are produced by the enzyme complex that produces the target PUFA(s). Preferably, any fatty acids that are produced by the enzyme complex that produces the target PUFA(s) (e.g., as a result of genetic modification of the plant with the enzyme or enzyme complex that produces the target PUFA(s)), other than the target PUFA(s), are present at less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% by weight of the total fatty acids produced by the plant.

In another embodiment, any fatty acids that are produced by the enzyme complex that produces the target PUFA(s) other than the target PUFA(s) are present at less than (or do not contain any more than) about 10% by weight of the total fatty acids that are produced by the enzyme complex that produces the target PUFA(s) in the plant (i.e., this measurement is limited to those total fatty acids that are produced by the enzyme complex that produces the target PUFAs), and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% by weight of the total fatty acids, and more preferably less than about 0.5% by weight of the total fatty acids that are produced by the enzyme complex that produces the target PUFA(s) in the plant.

In another aspect of this embodiment of the invention, the total fatty acids produced by the plant (and/or parts of plants or seed oil fraction) contain less than (or do not contain any more than) 10% PUFAs having 18 or more carbons by weight of the total fatty acids produced by the plant, other than the target PUFA(s) or the PUFAs that are present in the wild-type plant (not genetically modified) or in the parent plant used as a recipient for the indicated (initial or sequential) genetic modification. In further aspects, the total fatty acids produced by the plant (and/or parts of plants or seed oil fraction) contain less than 9% PUFAs having 18 or more carbons, or less than 8% PUFAs having 18 or more carbons, or less than 7% PUFAs having 18 or more carbons, or less than 6% PUFAs having 18 or more carbons, or less than 5% PUFAs having 18 or more carbons, or less than 4% PUFAs having 18 or more carbons, or less than 3% PUFAs having 18 or more carbons, or less than 2% PUFAs having 18 or more carbons, or less than 1% PUFAs having 18 or more carbons by weight of the total fatty acids produced by the plant, other than the target PUFA(s) or the PUFAs that are present in the wild-type plant (not genetically modified) or the parent plant used as a recipient for the indicated genetic modification.

In another aspect of this embodiment of the invention, the total fatty acids produced by the plant (and/or parts of plants or seed oil fraction) contain less than (or do not contain any more than) 10% PUFAs having 20 or more carbons by weight of the total fatty acids produced by the plant, other than the target PUFA(s) or the PUFAs that are present in the wild-type plant (not genetically modified) or the parent plant used as a recipient for the indicated (initial or sequential) genetic modification. In further aspects, the total fatty acids produced by the plant (and/or parts of plants or seed oil fraction) contain less than 9% PUFAs having 20 or more carbons, or less than 8% PUFAs having 20 or more carbons, or less than 7% PUFAs having 20 or more carbons, or less than 6% PUFAs having 20 or more carbons, or less than 5% PUFAs having 20 or more carbons, or less than 4% PUFAs having 20 or more carbons, or less than 3% PUFAs having 20 or more carbons, or less than 2% PUFAs having 20 or more carbons, or less than 1% PUFAs having 20 or more carbons by weight of the total fatty acids produced by the plant, other than the target PUFA(s) or the PUFAs that are present in the wild-type plant (not genetically modified) or the parent plant used as a recipient for the indicated genetic modification.

In one embodiment, the total fatty acids in the plant (and/or parts of plants or seed oil fraction) contain less than about 10% by weight of the total fatty acids produced by the plant, and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% of a fatty acid selected from any one or more of: gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9) and various other fatty acids, such as 20:0; 20:1 ($\Delta$5); 20:1 ($\Delta$11); 20:2 ($\Delta$8,11); 20:2 ($\Delta$11, 14); 20:3 ($\Delta$5,11,14); 20:3 ($\Delta$11,14,17); mead acid (20:3; $\Delta$5,8,11); or 20:4 ($\Delta$5,1,14,17).

In another embodiment, the fatty acids that are produced by the enzyme system that produces the long chain PUFAs in the plant contain less than about 10% by weight of a fatty acid selected from: gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9) and various other fatty acids, such as 20:0; 20:1 ($\Delta$5); 20:1 ($\Delta$11); 20:2 ($\Delta$8,11); 20:2 ($\Delta$11,14); 20:3 ($\Delta$5,11,14); 20:3 ($\Delta$11,14, 17); mead acid (20:3; $\Delta$5,8,1); or 20:4 ($\Delta$5,1,14,17), as a percentage of the total fatty acids produced by the plant, and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% of a fatty acid selected from: gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9) and various other fatty acids, such as 20:0; 20:1 ($\Delta$5); 20:1 ($\Delta$11); 20:2 ($\Delta$8,11); 20:2 ($\Delta$11,14); 20:3 ($\Delta$5,11, 14); 20:3 ($\Delta$11,14,17); mead acid (20:3; $\Delta$5,8,11); or 20:4 ($\Delta$5,1,14,17).

In another embodiment, the fatty acids that are produced by the enzyme system that produces the long chain PUFAs in the plant contain less than about 10% by weight of all of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds, as a percentage of the total fatty acids produced by the plant, and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% of all of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds.

In another embodiment, the fatty acids that are produced by the enzyme system that produces the long chain PUFAs in the plant contain less than about 10% by weight of each of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds, as a percentage of the total fatty acids produced by the plant, and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% of each of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds.

In another embodiment, the fatty acids that are produced by the enzyme system that produces the long chain PUFAs in the plant contain less than about 10% by weight of any one or more of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds, as a percentage of the total fatty acids produced by the plant, and more preferably less than about 9%, and more preferably less than about 8%, and more preferably less than about 7%, and more preferably less than about 6%, and more preferably less than about 5%, and more preferably less than about 4%, and more preferably less than about 3%, and more preferably less than about 2%, and more preferably less than about 1% of any one or more of the following PUFAs: gamma-linolenic acid (GLA; 18:3, n-6), PUFAs having 18 carbons and four carbon-carbon double bonds, PUFAs having 20 carbons and three carbon-carbon double bonds, and PUFAs having 22 carbons and two or three carbon-carbon double bonds.

In one aspect of this embodiment of the invention, the plant produces at least two target PUFAs, and the total fatty acid profile in the plant, or the part of the plant that accumulates PUFAs (including oils from the oil seeds), comprises a detectable amount of these PUFAs. In this embodiment, the PUFAs are preferably each at least a 20 carbon PUFA and comprise at least 3 double bonds, and more preferably at least 4 double bonds, and even more preferably, at least 5 double bonds. Such PUFAs are most preferably chosen from DHA, DPAn-6 and EPA. In one aspect, the plant produces DHA and DPAn-6, and the ratio of DHA to DPAn-6 is from about 1:10 to about 10:1 or greater, including any ratio in between. In a one embodiment, the ratio of DHA to DPA is from about 1:1 to about 3:1, and in another embodiment, about 2.5:1. In one embodiment, the plant produces DHA and EPA.

The invention further includes any seeds produced by the plants described above, as well as any plant parts, oils produced by the plants or seeds produced by the plants. The invention also includes any products produced using the plants, plant parts, seed or oils described herein.

One embodiment of the present invention relates to a method to modify an endproduct containing at least one fatty acid, comprising adding to said endproduct an oil produced by a recombinant host cell that expresses at least one recombinant nucleic acid molecule comprising a nucleic acid sequence encoding at least one biologically active domain of a PUFA PKS system as described herein.

Preferably, the endproduct is selected from the group consisting of a food, a dietary supplement, a pharmaceutical formulation, a humanized animal milk, and an infant formula. Suitable pharmaceutical formulations include, but are not limited to, an anti-inflammatory formulation, a chemotherapeutic agent, an active excipient, an osteoporosis drug, an anti-depressant, an anti-convulsant, an anti-Heliobactor pylori drug, a drug for treatment of neurodegenerative disease, a drug for treatment of degenerative liver disease, an antibiotic, and a cholesterol lowering formulation. In one embodiment, the endproduct is used to treat a condition selected from the group consisting of: chronic inflammation, acute inflammation, gastrointestinal disorder, cancer, cachexia, cardiac restenosis, neurodegenerative disorder, degenerative disorder of the liver, blood lipid disorder, osteoporosis, osteoarthritis, autoimmune disease, preeclampsia, preterm birth, age related maculopathy, pulmonary disorder, and peroxisomal disorder.

Suitable food products include, but are not limited to, fine bakery wares, bread and rolls, breakfast cereals, processed and unprocessed cheese, condiments (ketchup, mayonnaise, etc.), dairy products (milk, yogurt), puddings and gelatine desserts, carbonated drinks, teas, powdered beverage mixes, processed fish products, fruit-based drinks, chewing gum, hard confectionery, frozen dairy products, processed meat products, nut and nut-based spreads, pasta, processed poultry products, gravies and sauces, potato chips and other chips or crisps, chocolate and other confectionery, soups and soup mixes, soya based products (milks, drinks, creams, whiteners), vegetable oil-based spreads, and vegetable-based drinks.

Yet another embodiment of the present invention relates to a method to produce a humanized animal milk. This method includes the steps of genetically modifying milk-producing cells of a milk-producing animal with at least one recombinant nucleic acid molecule comprising a nucleic acid sequence encoding at least one biologically active domain of a PUFA PKS system as described herein.

Methods to genetically modify a host cell and to produce a genetically modified non-human, milk-producing animal, are known in the art. Examples of host animals to modify include cattle, sheep, pigs, goats, yaks, etc., which are amenable to genetic manipulation and cloning for rapid expansion of a transgene expressing population. For animals, PKS-like transgenes can be adapted for expression in target organelles, tissues and body fluids through modification of the gene regulatory regions. Of particular interest is the production of PUFAs in the breast milk of the host animal.

Each publication or reference cited herein is incorporated herein by reference in its entirety.

The following examples are provided for the purpose of illustration and are not intended to limit the scope of the present invention.

EXAMPLES

Example 1

The following example describes the construction of a synthetic Th.23B OrfC cloning vector for use in *Schizochytrium*.

Codon usage data for four large genes from *Schizochytrium* (e.g., ATCC 20888 or *Schizochytrium* N230D) (orfA, orfB, orfC, and FAS; described in U.S. Patent Application Publication No. 20020194641, U.S. Patent Application Publication No. 20070089199, or U.S. Patent Application Publication No. 20050191679) were combined. Given that *Schizochytrium* ATCC 20888 produces high levels of fatty acids, it is expected that these genes are highly expressed. Codons with less than about 3% representation (within those for a given amino acid) were eliminated, and the relative usage of the remaining codons was adjusted. Table 1 shows *Schizochytrium* codon usage, adjusted usage, and codon usage for non-synthetic Th.23B orfC. DNA2.0 (Menlo Park, Calif.) was used to analyze these codon usage data to design and synthesize a coding region for *Thraustochytrium* 23B orfC. Nucleotides were added to both ends of the coding region to encode restriction enzyme recognition sites that would facilitate subsequent manipulation of the synthetic gene. A small number of codons were adjusted (without changing the encoded amino acid of SEQ ID NO:62) to eliminate or add certain restriction enzyme recognition sequences (see below for an example). The resultant synthetic sequence was developed by DNA2.0 within a plasmid vector and is shown in FIG. 2B as "pThOrfC synth". Table 1 shows the codon usage of the synthetic coding region.

TABLE 1

| amino acid | codon | Schizo A, B & C plus FAS | | Adjusted/Target Usage | Th.23B orfC | | synthetic Th.23B orfC | |
|---|---|---|---|---|---|---|---|---|
| | | number | fraction | fraction | number | fraction | number | fraction |
| Arg | CGG | 7 | 0.013 | 0 | 13 | 0.18 | 0 | 0 |
| Arg | CGA | 6 | 0.011 | 0 | 13 | 0.18 | 0 | 0 |
| Arg | CGT | 94 | 0.173 | 0.21 | 17 | 0.24 | 11 | 0.15 |
| Arg | CGC | 436 | 0.803 | 0.79 | 17 | 0.24 | 61 | 0.85 |
| Arg | AGG | 0 | 0.000 | 0.00 | 9 | 0.13 | 0 | 0 |
| Arg | AGA | 0 | 0.000 | 0.00 | 3 | 0.04 | 0 | 0 |
| Ser | TCG | 244 | 0.327 | 0.34 | 19 | 0.19 | 32 | 0.33 |
| Ser | TCA | 10 | 0.013 | 0.00 | 16 | 0.16 | 0 | 0 |
| Ser | TCT | 64 | 0.086 | 0.10 | 12 | 0.12 | 10 | 0.10 |
| Ser | TCC | 230 | 0.308 | 0.29 | 19 | 0.19 | 32 | 0.33 |
| Ser | AGT | 19 | 0.025 | 0.00 | 12 | 0.12 | 0 | 0 |
| Ser | AGC | 179 | 0.240 | 0.27 | 20 | 0.20 | 24 | 0.24 |

TABLE 1-continued

| amino acid | codon | Schizo A, B & C plus FAS | | Adjusted/Target Usage | Th.23B orfC | | synthetic Th.23B orfC | |
|---|---|---|---|---|---|---|---|---|
| | | number | fraction | fraction | number | fraction | number | fraction |
| Leu | CTG | 111 | 0.123 | 0.13 | 36 | 0.28 | 13 | 0.10 |
| Leu | CTA | 2 | 0.002 | 0.00 | 7 | 0.05 | 0 | 0 |
| Leu | CTT | 148 | 0.164 | 0.18 | 33 | 0.26 | 33 | 0.26 |
| Leu | CTC | 623 | 0.690 | 0.69 | 27 | 0.21 | 82 | 0.64 |
| Leu | TTG | 18 | 0.020 | 0.00 | 21 | 0.16 | 0 | 0 |
| Leu | TTA | 1 | 0.001 | 0.00 | 4 | 0.03 | 0 | 0 |
| Gly | GGG | 7 | 0.009 | 0.00 | 21 | 0.18 | 0 | 0 |
| Gly | GGA | 38 | 0.047 | 0.04 | 33 | 0.29 | 5 | 0.04 |
| Gly | GGT | 174 | 0.216 | 0.25 | 17 | 0.15 | 35 | 0.30 |
| Gly | GGC | 585 | 0.728 | 0.71 | 44 | 0.38 | 75 | 0.65 |
| Val | GTG | 198 | 0.242 | 0.29 | 44 | 0.38 | 29 | 0.25 |
| Val | GTA | 4 | 0.005 | 0.00 | 14 | 0.12 | 0 | 0 |
| Val | GTT | 103 | 0.126 | 0.13 | 34 | 0.29 | 18 | 0.16 |
| Val | GTC | 512 | 0.627 | 0.58 | 24 | 0.21 | 69 | 0.59 |
| Ala | GCG | 214 | 0.159 | 0.17 | 21 | 0.18 | 20 | 0.17 |
| Ala | GCA | 41 | 0.031 | 0.00 | 36 | 0.31 | 0 | 0 |
| Ala | GCT | 236 | 0.176 | 0.21 | 33 | 0.28 | 25 | 0.22 |
| Ala | GCC | 853 | 0.635 | 0.62 | 26 | 0.22 | 71 | 0.61 |
| Thr | ACG | 156 | 0.297 | 0.28 | 19 | 0.30 | 21 | 0.33 |
| Thr | ACA | 13 | 0.025 | 0.00 | 8 | 0.13 | 0 | 0 |
| Thr | ACT | 71 | 0.135 | 0.22 | 16 | 0.25 | 10 | 0.16 |
| Thr | ACC | 285 | 0.543 | 0.50 | 20 | 0.32 | 32 | 0.51 |
| Pro | CCG | 195 | 0.340 | 0.32 | 19 | 0.24 | 27 | 0.35 |
| Pro | CCA | 12 | 0.021 | 0.00 | 17 | 0.22 | 0 | 0 |
| Pro | CCT | 116 | 0.202 | 0.27 | 29 | 0.37 | 19 | 0.24 |
| Pro | CCC | 250 | 0.436 | 0.41 | 13 | 0.17 | 32 | 0.41 |
| Ile | ATA | 0 | 0.000 | 0.00 | 2 | 0.03 | 0 | 0 |
| Ile | ATT | 136 | 0.298 | 0.28 | 40 | 0.57 | 16 | 0.23 |
| Ile | ATC | 320 | 0.702 | 0.72 | 28 | 0.40 | 54 | 0.77 |
| Glu | GAG | 683 | 0.912 | 0.90 | 47 | 0.56 | 77 | 0.92 |
| Glu | GAA | 66 | 0.088 | 0.10 | 37 | 0.44 | 7 | 0.08 |
| Asp | GAT | 143 | 0.237 | 0.26 | 33 | 0.37 | 22 | 0.24 |
| Asp | GAC | 460 | 0.763 | 0.74 | 57 | 0.63 | 68 | 0.76 |
| Lys | AAG | 551 | 0.960 | 0.90 | 40 | 0.48 | 73 | 0.88 |
| Lys | AAA | 23 | 0.040 | 0.10 | 43 | 0.52 | 10 | 0.12 |
| Asn | AAT | 22 | 0.062 | 0.11 | 12 | 0.21 | 6 | 0.10 |
| Asn | AAC | 331 | 0.938 | 0.89 | 46 | 0.79 | 52 | 0.90 |
| Cys | TGT | 7 | 0.050 | 0.06 | 12 | 0.36 | 4 | 0.12 |
| Cys | TGC | 134 | 0.950 | 0.94 | 21 | 0.64 | 29 | 0.88 |
| Tyr | TAT | 13 | 0.057 | 0.39 | 15 | 0.34 | 14 | 0.32 |
| Tyr | TAC | 214 | 0.943 | 0.61 | 29 | 0.66 | 30 | 0.68 |
| Phe | TTT | 160 | 0.451 | 0.47 | 44 | 0.62 | 28 | 0.39 |
| Phe | TTC | 195 | 0.549 | 0.43 | 27 | 0.38 | 43 | 0.61 |
| Gln | CAG | 306 | 0.924 | 0.90 | 26 | 0.47 | 50 | 0.91 |
| Gln | CAA | 25 | 0.076 | 0.10 | 29 | 0.53 | 5 | 0.09 |
| His | CAT | 29 | 0.173 | 0.15 | 10 | 0.32 | 7 | 0.23 |
| His | CAC | 139 | 0.827 | 0.85 | 21 | 0.68 | 24 | 0.77 |
| Met | ATG | 291 | 1.00 | 1 | 46 | 1 | 46 | 1 |
| Trp | TGG | 104 | 1.00 | 1 | 19 | 1 | 19 | 1 |

As described above, previous work by the present inventors and colleagues (see Example 8 in U.S. Patent Application Publication No. 20050100995) resulted in the creation of a plasmid in which the (non-synthetic) Th.23B orfC coding region was cloned between the *Schizochytrium* orfC upstream and downstream non-coding regions such that a "perfect stitch" with the Th.23B coding region was generated. Intermediate plasmids in this process can be used to clone the synthetic Th.23B orfC coding region (see FIGS. 2A and 2B). In order to most easily utilize one of these intermediate constructs, a 283 bp nucleotide sequence was designed by the inventors and synthesized by DNA2.0 to create the "perfect stitch" junctions and to utilize restriction sites within the *Schizochytrium* orfC upstream/downstream regions and designed into the synthetic Th.23B orfC gene for subsequent cloning reactions. This short DNA sequence was designated "Th23B synth orfC INT" and was contained within the plasmid "pThOrfC stitch INT".

The 283 bp "Th23B synth orfC INT" consists of five segments. The first segment consists of the final 102 bp of the *Schizochytrium* orfC upstream (non-coding) region from a SpeI site up to but not including the ATG start codon of *Schizochytrium* orfC (see SEQ ID NO:77). The second segment consists of the initial 9 bp of the synthetic Th.23B orfC coding region (SEQ ID NO:61) and contains the start ATG overlapping a designed SanDI site (GGGTCCC). These segments create the upstream "perfect stitch" junction. The third segment is a 6 bp BamHI restriction site (GGATCC) that functions as a spacer. The fourth segment consists of the final 45 bp of the Th.23B orfC coding region (SEQ ID NO:61) from a designed ClaI site to the TAA stop codon. The fifth segment consists of the initial 121 bp of the *Schizochytrium* orfC (non-coding) downstream region (not including the stop codon) to a "reverse" BsmI site. The final six nucleotides of the "Th23B synth orfC INT" fragment in the "forward" orientation are 5'>GCATTC>3'. The reverse complement 5'>GAATGC>3' is the recognition sequence for BsmI. The fourth and fifth segments create the downstream "perfect stitch" junction.

Construction details of the "perfect stitch" version of the synthetic Th.23B orfC coding sequence is given below (see also FIGS. 2A and 2B).

Figure 2A:
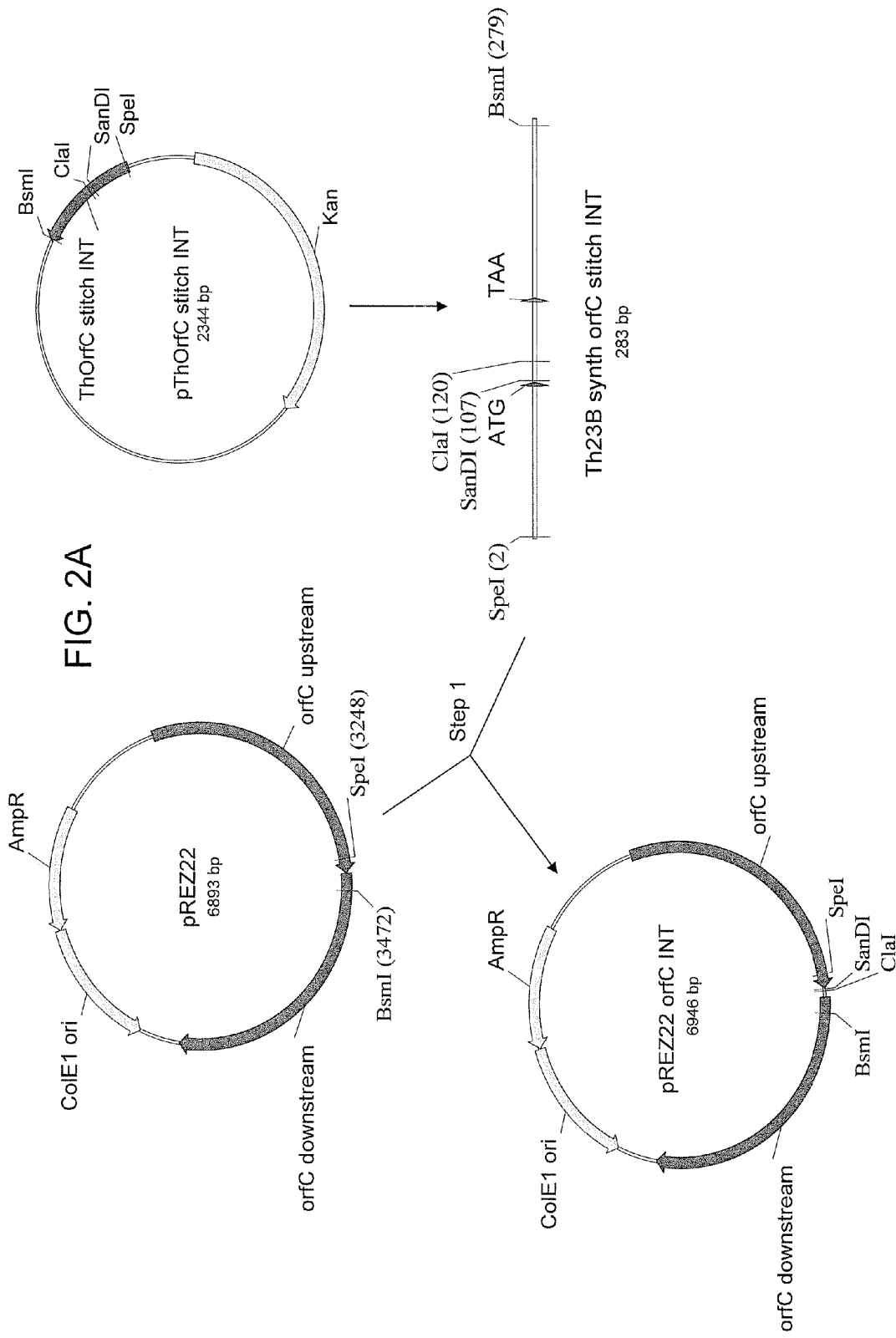
FIG. 2A is a schematic drawing showing step 1 of the construction of a plasmid containing a synthetic, *Schizochytrium* codon-optimized nucleic acid sequence encoding OrfC from *Thraustochytrium* 23B (pThOrfC_synPS), as well as intermediate plasmids produced by the process.
Figure 2B:
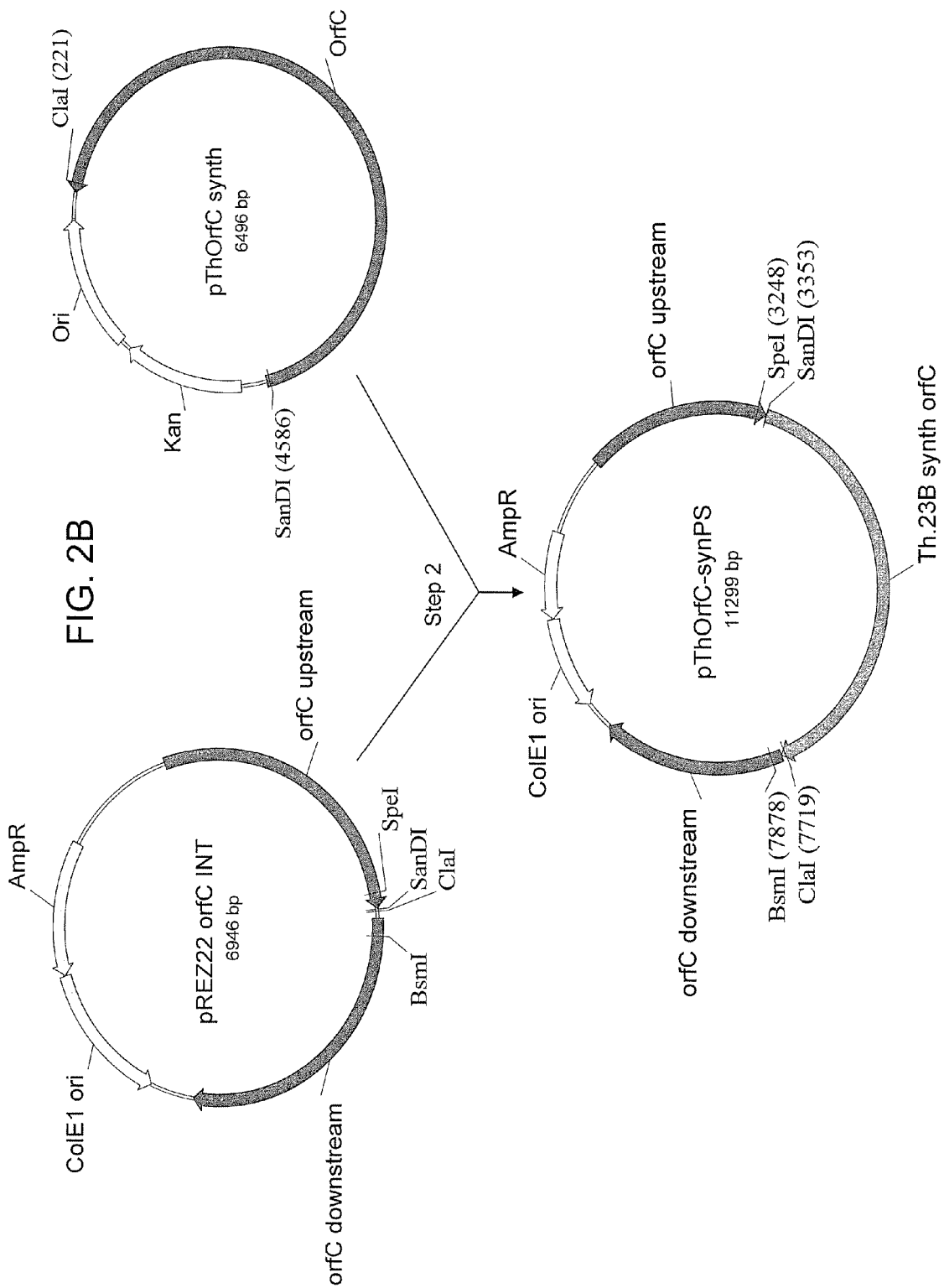
FIG. 2B is a schematic drawing showing step 2 of the construction of a plasmid containing a synthetic, *Schizochytrium* codon-optimized nucleic acid sequence encoding OrfC from *Thraustochytrium* 23B (pThOrfC_synPS), as well as intermediate plasmids produced by the process.

Step 1 (FIG. 2A). The "Th23B synth orfC INT" fragment from pThOrfC stitch INT was removed by digestion with SpeI and BsmI restriction enzymes, and the fragment was purified by agarose gel electrophoresis (GeneClean Turbo kit, QBioGene). Similarly, the large SpeI/BsmI vector fragment from pREZ22 (see U.S. Patent Application Publication No. 20050100995), containing about 2000 bp each of the *Schizochytrium* orfC upstream and downstream regions separated by a BamHI recognition site spacer cloned into pBlue-ScriptII SK(+)) was obtained. These two fragments were ligated and transformed into *E. coli* XL-1 Blue (Stratagene, La Jolla, Calif.). Clones containing the desired plasmid, "pREZ22 orfC INT", were identified by restriction digests and partial DNA sequencing. This plasmid contains the *Schizochytrium* orfC upstream and downstream regions perfectly stitched to the 5-prime and 3-prime regions, respectively, of the synthetic orfC coding region, but is lacking the bulk of the coding region.

Step 2 (FIG. 2B). The bulk of the synthetic Th.23B orfC coding region was obtained from "pThOrfC synth" by digestion with SanDI and ClaI restriction enzymes and purification of the desired DNA fragment (as above). This fragment was ligated into a similarly obtained vector fragment from pREZ22 orfC INT and cloned into *E. coli* (as above). The resulting plasmid, "pThOrfC-synPS", contains the full length synthetic Th.23B orfC coding region perfectly stitched to the upstream and downstream regions of the *Schizochytrium* orfC gene. The nucleotide sequence of the coding region of pThOrfC-synPS is represented herein by SEQ ID NO:70. SEQ ID NO:70 encodes SEQ ID NO:62. pThOrfC-synPS has been deposited as ATCC Accession No. PTA-8229, as described previously herein.

Example 2

The following example describes the creation of a construct encoding *Schizochytrium* OrfC comprising a DH2 domain from *Thraustochytrium* 23B.

The DH2 region of *Schizochytrium* ATCC20888 OrfC (SEQ ID NO:30) was replaced with that from *Thraustochytrium* 23B ATCC 20892 (SEQ ID NO:66) at specific 5-prime and 3-prime cross-over points by a combination of PCR-based overlap extension ("Splicing by Overlap Extension" or "SOEing" (Horton, R. M., (1993) In Vitro Recombination and Mutagenesis of DNA. SOEing together tailor-made genes. *Methods in molecular Biology* Vol. 15: *PCR Protocols: Current Methods and Applications* Chapter 25 pp 251-266 (B. A. White, Ed.) Humana Press, Totawa, N.J.)) and restriction cloning.

More specifically, in this example, the inventors constructed a nucleic acid molecule encoding a hybrid (chimeric) OrfC polypeptide (amino acid sequence represented herein by SEQ ID NO:74), 1493 amino acid residues in length, in which the DH2 region, defined as amino acids 516-1041 of this hybrid, consists of the amino acid sequence of the DH2 region of the Th.23B OrfC protein; that is, amino acids 491-1016 of SEQ ID NO:62, which includes all of SEQ ID NO:66 (described as the DH2 domain of *Thraustochytrium* 23B herein). The remainder of the hybrid OrfC amino acid sequence, residues 1-515 and 1042-1493 of SEQ ID NO:74, are identical to *Schizochytrium* OrfC residues 1-515 and 1051-1502 of SEQ ID NO:6, respectively.

Figure 3A:
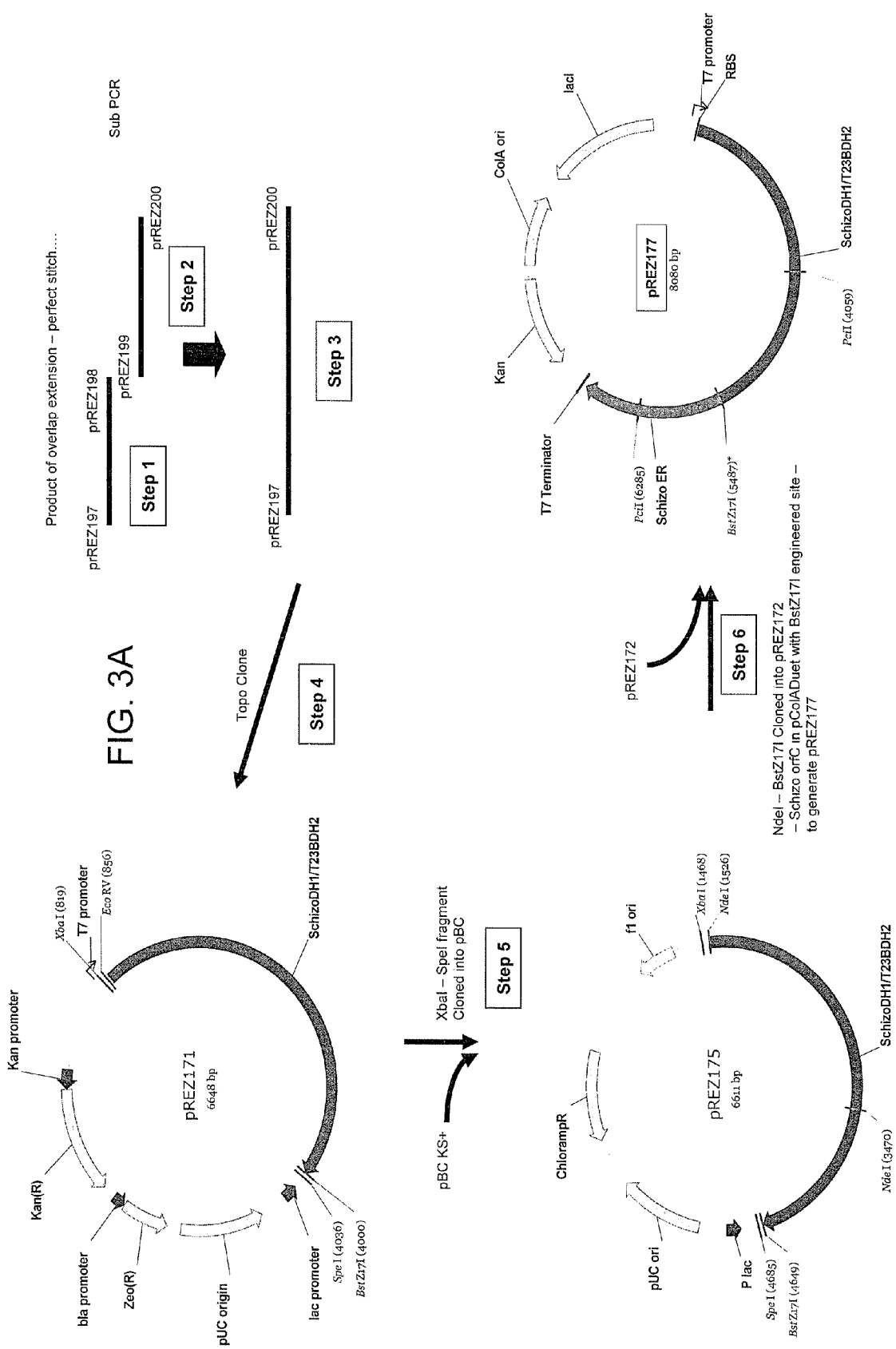
FIG. 3A is a schematic drawing showing steps 1-6 of the construction of a plasmid encoding *Schizochytrium* OrfC comprising a native DH2 domain from *Thraustochytrium* 23B (pDS49), as well as intermediate plasmids produced by the process.
Figure 3B:
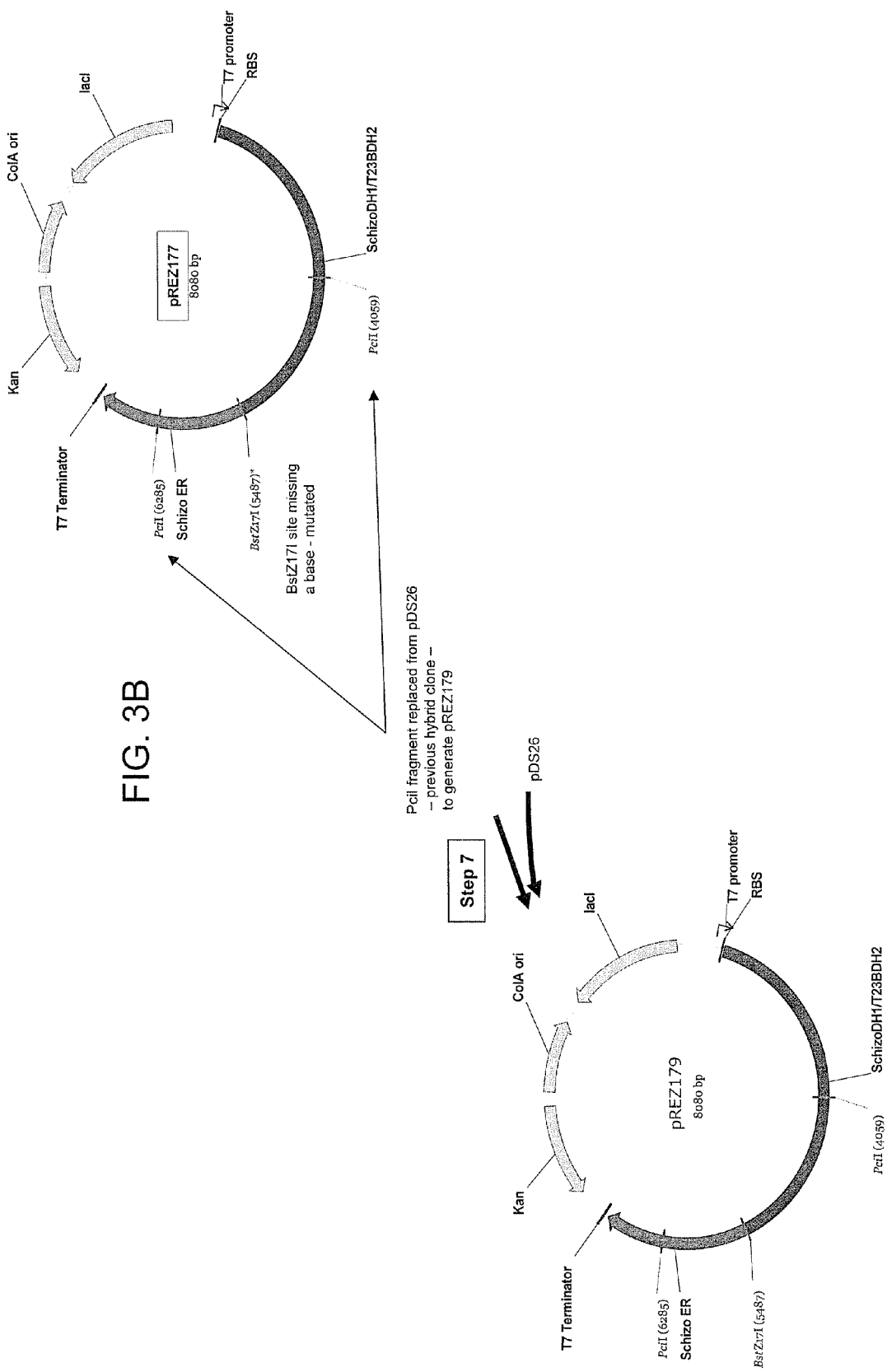
FIG. 3B is a schematic drawing showing step 7 of the construction of a plasmid encoding *Schizochytrium* OrfC comprising a native DH2 domain from *Thraustochytrium* 23B (pDS49), as well as intermediate plasmids produced by the process.
Figure 3C:
FIG. 3C is a schematic drawing showing steps 8-9 of the construction of a plasmid encoding *Schizochytrium* OrfC comprising a native DH2 domain from *Thraustochytrium* 23B (pDS49), as well as intermediate plasmids produced by the process.

The construction of the plasmid encoding this chimeric protein is illustrated in FIGS. 3A-3C.

Step 1 Primers prREZ197 (SEQ ID NO:78) and prREZ198 (SEQ ID NO:79) were used to amplify approximately 1.5 Kb of the *Schizochytrium* orfC reading frame upstream of the DH2 region using the unmodified *Schizochytrium* orfC gene as a template:

prREZ197   <u>CATATG</u>GCGCTCCGTGTCAA prREZ198   GCCAGGAAGCTTTGACATGGGGTGCCAGGACATCT

Primer prREZ197 created an NdeI site (underlined) at the start ATG codon. Reverse primer prREZ198 (35 mer) contained the 5-prime cross-over point generated by 20 bp of homology to *Schizochytrium* OrfC sequence (bold type) and 15 bp of homology to Th.23B OrfC sequence. PCR conditions: 50 µL reaction, 1 µL PfuUltra polymerase (Stratagene) and 1×PfuUltra buffer, 2% DMSO, 0.5 µM each dNTP, 0.4 µM each prRZ197 and prRZ198, 10 ng template (cloned *Schizochytrium* orfC coding region), 1 min. initial denaturation at 94° C., 20 cycles of 1 min. denaturation at 94° C., 1 min. annealing at 52° C., 90 sec. extension at 72° C., and 10 min. final extension. The PCR product was purified following agarose gel electrophoresis using the QIAquick® Gel Extraction Kit (Qiagen, Valencia, Calif.).

Step 2 Primers prREZ199 (SEQ ID NO:80) and prREZ200 (SEQ ID NO:81) were used to amplify the Th.23B DH2 region (approximately 1.5 Kb) using the Th.23B orfC gene as a template.

prREZ199   TCCTGGCACCCCATGTCAAAGCTTCCTGGCAACCCTA prREZ200   <u>AGTATAC</u>AGAGGTGCTGACA

Primer prREZ199 (37 mer) contained the 5-prime cross-over point generated by 22 bp of homology to Th.23B orfC (DH2) sequence and 15 bp of homology to *Schizochytrium* orfC sequence (bold). These latter 15 bp also provided overlap with prREZ198 and thus the PCR product of Step 1. Reverse primer prREZ200 incorporated a natural BstZ17I site in Th.23B orfC at the 3-prime cross-over point (underline). PCR conditions and fragment purification were as above except primers prREZ199 and prREZ200 were used with 10 ng on cloned Th.23B orfC coding region as the template.

Step 3. Overlap extension was used to create the full-length fusion between the 5-prime end of the *Schizochytrium* orfC coding region and the Th.23B DH2 region. PCR was performed with the product of Step 1 (prREZ197×prREZ198) and Step 2 (prREZ199×prREZ200) as templates and the outside primers prREZ197 and prREZ200. PCR conditions: 50 µL reaction, 1 µL PfuUltra polymerase (Stratagene) and 1×PfuUltra buffer, 2% DMSO, 0.5 µM each dNTP, 0.4 µM each prRZ197 and prRZ200, 50 ng each PCR product from Steps 1 and 2, 1 min. initial denaturation at 94° C., 20 cycles of 1 min. denaturation at 94° C., 1 min. annealing at 52° C., 3.5 min. extension at 72° C., and 10 min. final extension. The PCR product was purified as in Step 1.

Step 4 The product of the PCR reaction in Step 3 was cloned into pCR-BluntII-TOPO (Invitrogen) and transformed into TOP10 *E. coli* (Invitrogen) using the manufacturer's recommended conditions to create pREZ171. The sequence of the insert DNA was confirmed to be as designed.

Step 5 Using restriction sites in the respective vector sequences, the cloned DNA in pREZ171 was transferred to vector pBC KS(+) (Stratagene) as an XbaI/SpeI fragment to create pREZ175.

Step 6 Plasmid pREZ175 was digested (linearized) with BstZ17I, then partially digested with NdeI. A ca. 6 Kb fragment representing the fused *Schizochytrium* orfC 5-prime region and Th.23B DH2 region was cloned into the pREZ172 NdeI/BstZ17I vector fragment creating pREZ177. Plasmid pREZ172 contains the entire *Schizochytrium* orfC coding region cloned into the *E. coli* expression vector pColADuet-1 (Novagen) such that the start ATG codon incorporates an NdeI site. It derives from pREZ101 (see Example 5), and had been modified by site-directed mutagenesis (Quik Change kit, Stratagene) to insert an amino acid-neutral BstZ17I site at the 3-prime cross-over site. Specifically, the TAC tyrosine codon at amino acid position 1051 was modified to TAT.

Step 7 Upon analysis of pREZ177 by DNA sequencing, it was discovered that a single base pair at the BstZ17I site had been deleted. Specifically, the expected <GTATAC> was instead <GTAAC>. To correct this error, a PciI restriction fragment containing the correct BstZ17I cross-over point from pDS26 was used to replace the defective PciI fragment in pREZ177. Plasmid pDS26 contains a hybrid orfC coding region that had been previously created for other purposes. The resulting plasmid, pREZ179, therefore contains an entire orfC coding region that is predominantly from *Schizochytrium* but contains a precise replacement of the DH2 region with that from Th.23B (the amino acid sequence represented herein by SEQ ID NO:74). Plasmid pREZ179 further represents a unique tool to study function of the hybrid gene in *E. coli* and provides a starting point for the development of expression vectors for other organisms.

The following additional steps (see FIG. 3C) describe the transfer of the hybrid gene from pREZ179 to a vector for gene replacement in *Schizochytrium*.

Step 8 The (unmodified) *Schizochytrium* orfC coding region plus short portions of upstream and downstream flanking sequences was isolated from pBR002 (a clone of the orfC genomic region) as a NheI/BspEI fragment. This fragment was then cloned into the vector portion of NheI/BspEI-digested pREZ31 (functionally equivalent to pREZ33 described in U.S. Patent Application Publication No. 20050100995, Example 8). The resulting plasmid, pDS48, contains the (unmodified) *Schizochytrium* orfC coding region plus the same upstream and downstream sequences that have been used to drive gene replacement at the orfC locus.

Step 9 A portion of the hybrid orfC reading frame containing the entire exchanged Th.23B DH2 region was isolated from pREZ179 as a PstI/PflMI fragment. This fragment was cloned into the vector portion of PstI/PflMI-digested pDS48 to yield pDS49. As a result, plasmid pDS49 contains the hybrid orfC within the same context as pREZ33 (full-length Th.23B orfC coding region as a "perfect stitch" gene replacement; see U.S. Patent Application Publication No. 20050100995, Example 8). The nucleotide sequence of the coding region of pDS49 is represented herein by SEQ ID NO:73. SEQ ID NO:73 encodes SEQ ID NO:74. Plasmid pDS49 was deposited as ATCC Accession No. PTA-8230, as described in detail previously herein.

Example 3

The following example describes the construction of a construct encoding *Schizochytrium* OrfC comprising a DH2 domain from *Thraustochytrium* 23B, wherein the DH2 domain has been resynthesized to be optimized for *Schizochytrium* codon usage.

Figure 4C:
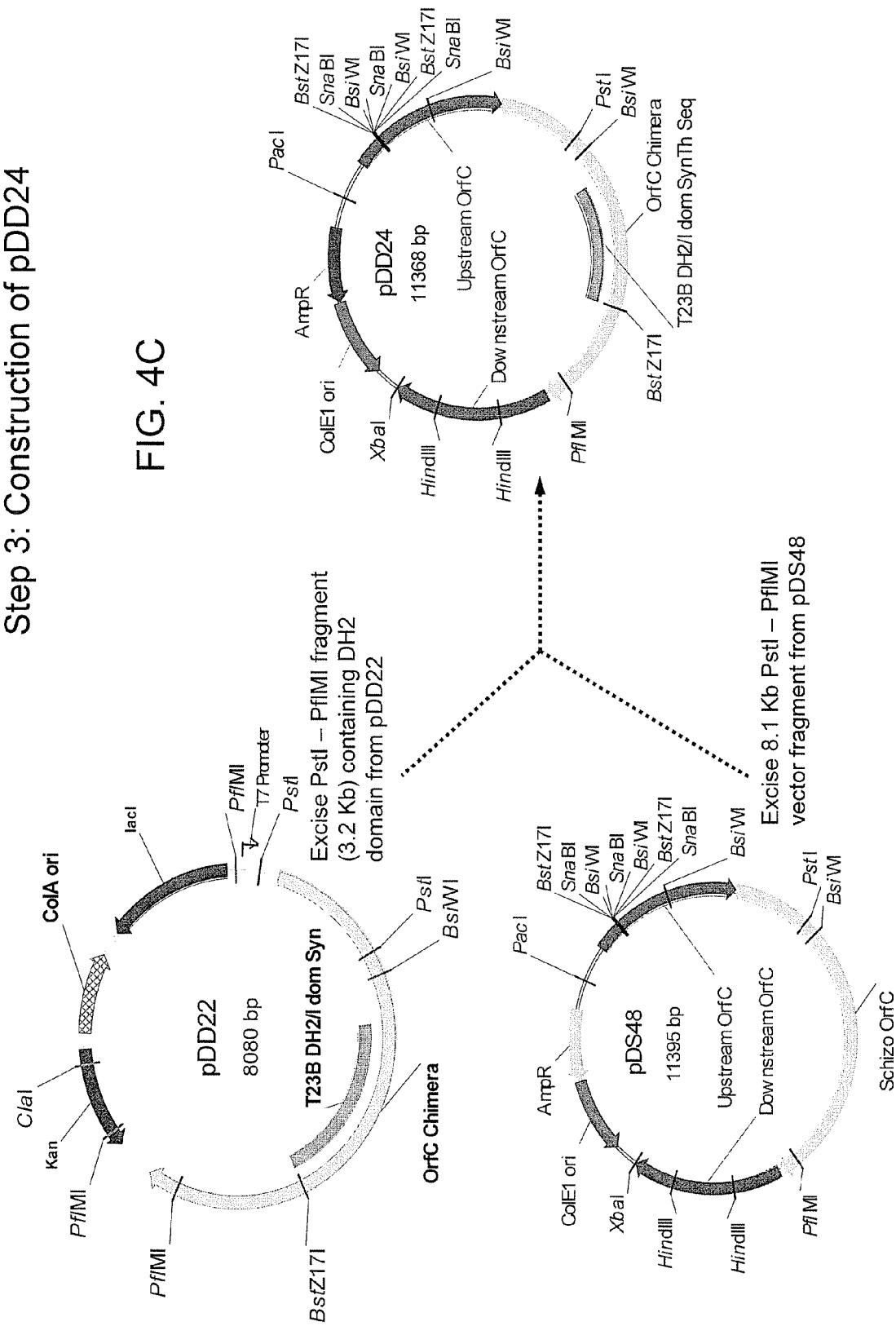
FIG. 4C is a schematic drawing showing the construction of plasmid pDD24 as the final step in the construction of a plasmid encoding *Schizochytrium* OrfC comprising a synthetic, *Schizochytrium* codon-optimized DH2 domain from *Thraustochytrium* 23B (pDD24), as well as intermediate plasmids produced by the process.
Figure 5:
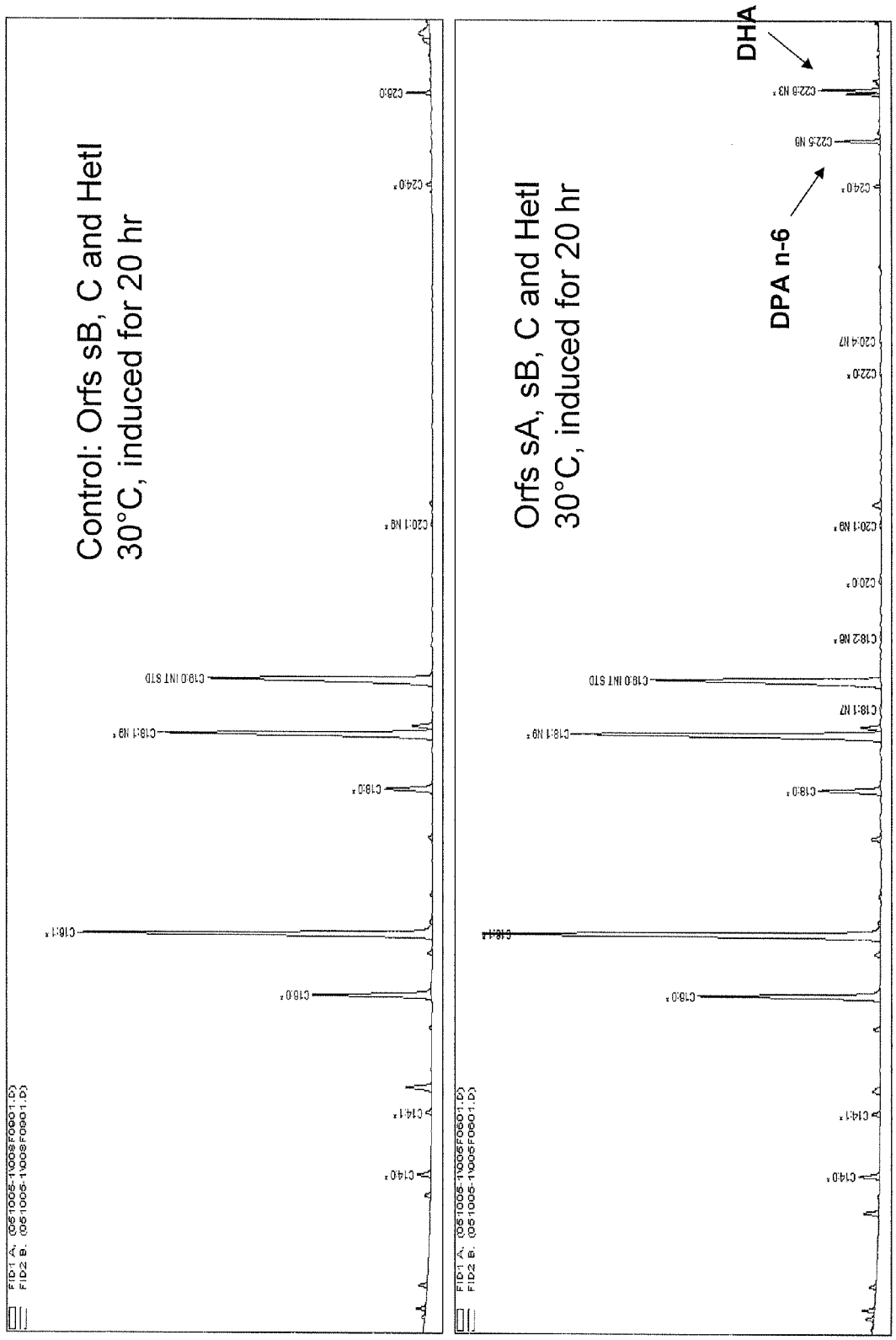
FIG. 5 is a FAME profile of control yeast and yeast expressing *Schizochytrium* OrfsA, OrfsB, OrfC and Het I.
Figure 6:
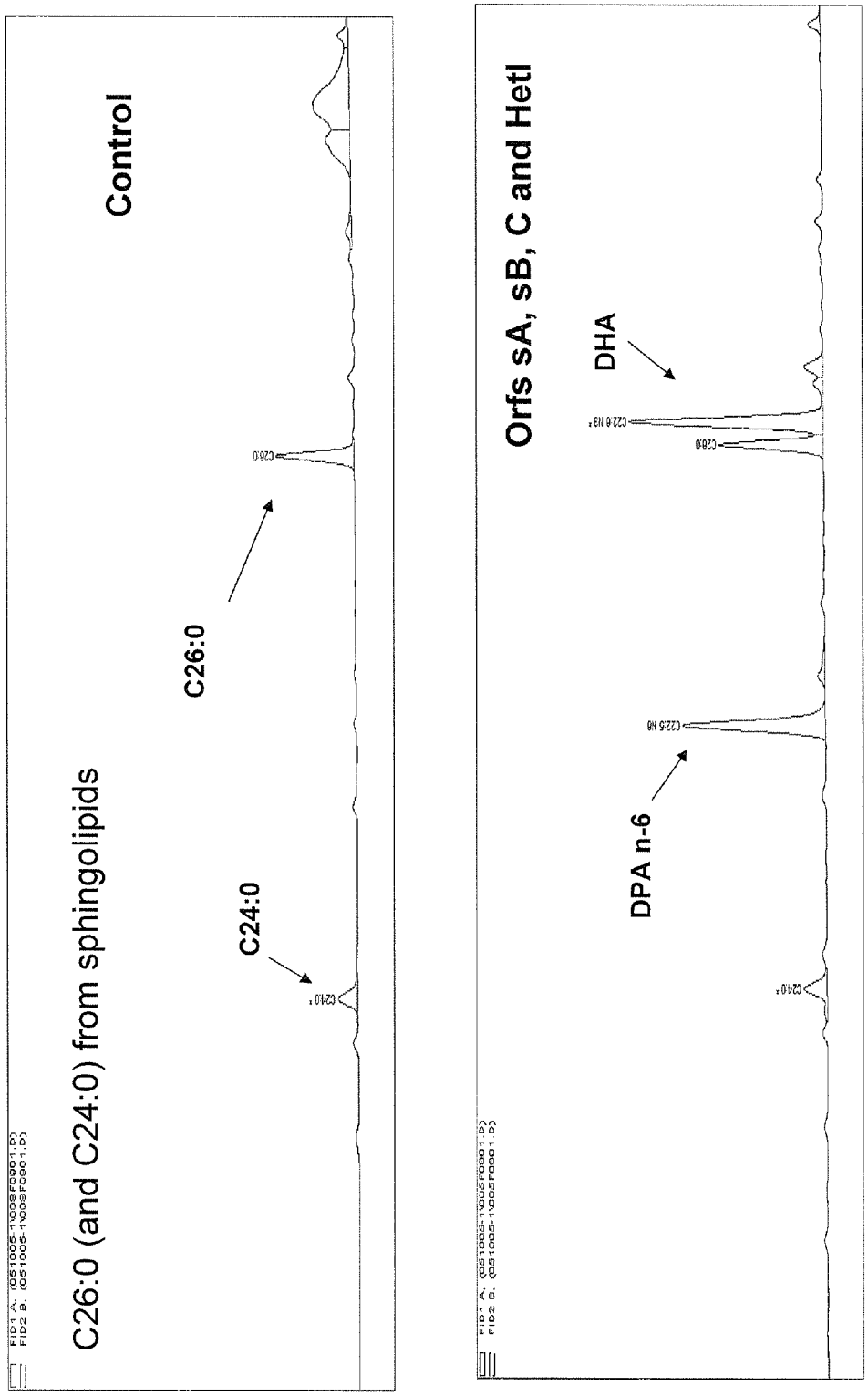
FIG. 6 is the FAME profile for yeast from FIG. 5, expanded to illustrate the production of target PUFAs.

In this example, the inventors constructed a nucleic acid molecule encoding a hybrid OrfC polypeptide (SEQ ID NO:74), 1493 amino acid residues in length, in which the DH2 region, defined as amino acids 516-1041 of this hybrid, consists of the amino acid sequence of the DH2 region of the Th.23B OrfC protein; that is, amino acids 491-1016 of SEQ ID NO:62, which includes all of SEQ ID NO:66 (described as the DH2 domain of *Thraustochytrium* 23B herein). The remainder of the hybrid OrfC amino acid sequence, residues 1-515 and 1042-1493 of SEQ ID NO:74, are identical to *Schizochytrium* OrfC residues 1-515 and 1051-1502 of SEQ ID NO:6, respectively. Moreover, in this construct, the DNA sequence encoding amino acids 516-1041 was derived from the "synthetic gene sequence" for OrfC of Th.23B that is contained in plasmid pThOrfC synth and pThOrfC_synPS (see Example 1 and SEQ ID NO:70) and which employs codons that are preferred for gene expression in *Schizochytrium*. The construction details are illustrated in FIGS. 4A-4C and described below.

The DNA sequences encoding the DH2 region of the T23B OrfC polypeptide were amplified by PCR (Rxn 59/60) from pThOrfC synth using oligonucleotide primers dhd59 (5> GCACCCCATGAGCAAGCTCCCC GGC AAC>3; SEQ ID NO:82) and dhd60 (5>GT ATA CAG AGG CGC AGA CAC GTT GTA AG>3; SEQ ID NO:83). The "forward" or sense-strand primer dhd59 overlaps the DNA sequence encoding amino acid residues 491-501 (WHPMSKLPGNP; positions 491-501 of SEQ ID NO:62) of the Th.23B OrfC protein. The "reverse" or antisense-strand primer dhd60 overlaps the DNA sequence encoding amino acid residues 1008-1017 (TYNVSAPLYT; positions 1008-1017 of SEQ ID NO:62) of the Th.23B OrfC protein. Primer dhd60 contains two mismatches with the pThOrfC synth sequence which are indicated by the boxed residues in the dhd60 sequence above. These changes created a BstZ17 I restriction endonuclease site, indicated by the double-underlined portion of the dhd60 sequence above, in order to facilitate subsequent cloning steps and also introduced two "silent mutations" into the coding sequence of the hybrid protein: CTT(L) to CTG(L) and TAC(Y) to TAT(Y). This amplification was carried out in a reaction volume of 40 μl of 1×PfuUltra™ HF reaction buffer (Stratagene, LaJolla, Calif.) containing dhd59 and dhd60 at 0.5 μM each, 200 μM dNTPs, 2 units of PfuUltra™ high-fidelity DNA polymerase (Stratagene, LaJolla, Calif.) and 1 ng of pThOrfC synth DNA. Cycling parameters were: 1×[1 min @ 94° C.], 28×[(1 min @ 94° C.), (0.5 min @ 60° C.), (1.5 min @ 72° C.)], 1×[8.5 min @ 72° C.], and hold @ 4° C. The reaction was performed in a Perkin Elmer GeneAmp® PCR System 2400 thermocycler (Applied Biosystems, Foster City, Calif.).

The DNA sequence encoding amino acid residues 331-522 of the hybrid OrfC protein encoded by pREZ179 was amplified by PCR (Rxn 57/58) from pREZ179 using oligonucleotide primers dhd57 (5>C TGC AGC CAG ATG CTC AAG ATG TAC ATG>3; SEQ ID NO:84) and dhd58 (5> GGAGCTTGCTCATGGGGTGCCA GGA CAT CTC>3; SEQ ID NO:85). The "forward" or sense-strand primer dhd57 overlaps the DNA sequence encoding amino acid residues 330-339 (GCSQMLKMYM; positions 330-339 of SEQ ID NO:74) of the hybrid OrfC protein encoded by pREZ179. The "reverse" or antisense-strand primer dhd58 overlaps the DNA sequence encoding amino acid residues 513-523 (EMSWHPMSKLP; positions 513-523 of SEQ ID NO:74) of the hybrid OrfC protein. The 5' end of the forward primer, dhd57, overlaps the Pst I site present in the hybrid OrfC coding sequence contained in pREZ179. This amplification was carried out in a reaction volume of 40 μl of 1×PfuUltra™ HF reaction buffer (Stratagene, LaJolla, Calif.) containing dhd57 and dhd58 at 0.5 μM each, 200 μM dNTPS, 2 units of PfuUltra™ high-fidelity DNA polymerase (Stratagene, LaJolla, Calif.) and 1 ng of pREZ179 DNA. Cycling parameters were:

1×[1 min @ 94° C.], 28×[(1 min @ 94° C.), (0.5 min @ 60° C.), (1.5 min @ 72° C.)], 1×[8.5 min @ 72° C.], and hold @ 4° C. The reaction was performed in a Perkin Elmer Gene-Amp System 2400 thermocycler.

Four microliters of each of the 57/58 and 59/60 reactions were run out on 1.2% agarose gel. DNA bands were observed in each case that were consistent with the expected product sizes: 578 bp for the 57/58 product and 1578 bp for the 59/60 product. These bands were excised from the gel and the DNA recovered from the agarose slices using a QIAquick® Gel Extraction Kit (QIAGEN, Inc. Valencia, Calif.) according to the vendor protocol. The PCR products were recovered in 40 µl of elution buffer.

The 5' 20 nucleotides of the reverse primer dhd58 (underlined above) comprise the reverse complement of the 5' 20 nucleotides of dhd59, also underlined above. As a result, there is a 20 bp identical overlap between the 3' end of the Rxn 57/58 product and the 5' end of the Rxn 59/60 product and this overlap allows subsequent PCR splicing of these two products by the technique of PCR "Splicing by Overlap Extension" or "SOEing" [Horton, R. M., (1993) In Vitro Recombination and Mutagenesis of DNA. SOEing together tailor-made genes. *Methods in molecular Biology* Vol. 15: *PCR Protocols: Current Methods and Applications* Chapter 25 pp 251-266 (B. A. White, Ed.) Humana Press, Totawa, N.J.]. This spliced fragment then contains useful restriction sites at (BstZ17 I & Pst I) or near (BsiW I) its ends.

The PCR splicing reaction (Rxn 57/60) was performed as follows. A 40 µl reaction volume of 1×PfuUltra™ HF reaction buffer contained primers dhd57 and dhd60 each at 0.5 µM, 200 µM dNTPS, 2 units of PfuUltra™ high-fidelity DNA polymerase (Stratagene, LaJolla, Calif.) and 0.8 µl of a 50-fold dilution of each of the gel-purified PCR products 57/58 and 59/60. A series of PCR splicing reactions was performed in which the annealing temperature was varied in 1° C. increments between 66-70° C. Other cycling parameters were constant: 1×[1 min @ 98° C.], 33×[(1 min @ 98° C.), (1 min @ 66-70° C.), (2.5 min @ 72° C.)], 1×[7.5 min @ 72° C.], and hold @ 6° C. The reaction was performed in a RoboCycler® Temperature Cycler (Stratagene, LaJolla, Calif.). Aliquots of these reactions were run out on 1% agarose gel and it was observed that all reactions contained a product consistent in size with the expected product (2136 bp) but other bands were also observed at all annealing temperatures. Therefore, the 3 reactions with annealings at 67, 68 and 69° C. were pooled, run out on a 1% agarose gel and the approximately 2.1 kb band of interest was excised and the DNA fragment recovered using a QIAquick® Gel Extraction Kit (QIAGEN, Inc. Valencia, Calif.) according to the vendor protocol. Eluted DNA was recovered in 30 µl of elution buffer and cloned into the PCR fragment cloning vector pCR®-Blunt II TOPO® (Invitrogen Corp., Carlsbad, Calif.) using the Zero Blunt® TOPO® PCR Cloning Kit (Invitrogen Corp., Carlsbad, Calif.) according to the vendor protocols. Products of the TOPO cloning reaction were used to transform One Shot® TOP10 Chemically Competent *E. coli* (Invitrogen) according to the vendor protocol. Eight of the resulting transformants were grown overnight and plasmid DNAs were prepared and analyzed by restriction endonuclease digestion and agarose gel electrophoresis. Seven of the eight were found to contain the cloned 2.1 kb PCR product 57/60. The cloned PCR 57/60 product of one isolate was sequenced and shown to exactly match the expected sequence. DNA sequencing was performed by the Biotechnology Resource Center of Cornell University (Ithaca, N.Y.) on a fee for service basis using the Applied Biosystems Automated 3730 DNA Analyzer, with Big Dye Terminator chemistry and AmpliTaq-FS DNA Polymerase (Applied Biosystems, Foster City, Calif.). The plasmid containing the sequence-verified insert was designated pDD21 and was used in further construction steps described below.

The DNA segment encoding the Th.23B DH2 domain optimized for *Schizochytrium* codon usage was excised from pDD21 and cloned into pREZ179 (see Example 2) so that it replaced the native Th.23B DH2 domain coding sequence present in that construct. The resulting plasmid, pDD22, was constructed as follows. Purified pDD21 DNA was digested with BsiWI and BstZ17I (New England BioLabs, Beverly Mass.) according to the vendor protocols. The reaction was subsequently subjected to treatment using the QIAquick® Spin Purification Procedure and QIAquick® PCR Purification Kit (QIAGEN Inc., Valencia, Calif.) according to the vendor protocol. The purified digestion products were run out on a 1% agarose gel and the 1940 bp BsiWI-BstZ17I fragment was excised and eluted from the agarose using a QIAEX II Gel Extraction Kit (QIAGEN Inc., Valencia, Calif.) according to the vendor protocol. Purified pREZ179 DNA was also digested BsiWI and BstZ17I and subsequently treated with Antarctic Phosphatase (New England BioLabs, Beverly, Mass.) according to the vendor protocol. The phosphatased digestion products were also subjected to treatment using the QUIquick® procedure as described above and run out on a 0.7% agarose gel. The ~6.1 Kb BsiWI-BstZ17I vector fragment was excised from the gel and eluted from the agarose using the QIAEX II Gel Extraction Kit described above. These two fragments were ligated in 1×T4 Ligase Reaction Buffer using T4 Ligase, both from New England BioLabs (Beverly, Mass.). Liagation products were used to transform One Shot® TOP10 Chemically Competent *E. coli* (Invitrogen) according top the vendor protocol. Plasmids DNA from three of the resulting transformants were analyzed by restriction endonuclease digestion and agarose gel electrophoresis and all three were found to have the structure of the expected recombinant. One plasmid was designated pDD22 and was employed in further constructions.

In order to facilitate the introduction of the DNA encoding the hybrid OrfC containing the Th.23B DH2 region encoded by *Schizochytrium*-preferred codons into the *Schizochytrium* genome, a PstI-PflMI DNA segment spanning the sequence encoding the DH2 region was excised from pDD22 and cloned into pDS48 (see Example 2), a vector designed for gene replacement at sequences at the orfC gene locus in *Schizochytrium*. The resulting plasmid, pDD24, which was used to in subsequent gene replacements, was constructed as follows. The DNA segment encoding T23B DH2 domain and with optimized codon usage was excised from pDD22 and cloned into pDS48 so that it replaced the native *Schizochytrium* DH2 domain coding sequence present in that construct. Purified pDD22 DNA was digested with PstI, PflMI and ClaI (New England BioLabs, Beverly Mass.) according to the vendor protocols. Digestion with ClaI cleaved a PflMI-PflMI fragment that would otherwise migrate close to the position of the PstI-PflMI ~3.2 Kb fragment of interest. The reaction was subsequently subjected to treatment using the QIAquick® Spin Purification Procedure and QIAquick® PCR Purification Kit (QIAGEN Inc., Valencia, Calif.) according to the vendor protocol. The purified digestion products were run out on a 0.7% agarose gel and the ~3.2 Kb PstI-PflMI fragment of interest was excised and eluted from the agarose using a QIAEX II Gel Extraction Kit (QIAGEN Inc., Valencia, Calif.) according to the vendor protocol. Purified pDS48 DNA was similarly digested with PflMI and PstI, subjected to the QIAquick® treatment as described above and run out on a 0.7% agarose gel. The ~8.0

Kb PstI-PflMI vector fragment was excised from the gel and eluted from the agarose using the QIAEX II Gel Extraction Kit described above. These two fragments were ligated in 1×T4 Ligase Reaction Buffer using T4 Ligase, both from New England BioLabs (Beverly, Mass.). Liagation products were used to transform One Shot® TOP10 Chemically Competent *E. coli* (Invitrogen) according top the vendor protocol. Resulting transformants were grown overnight in liquid culture of LB media containing 100 µg/ml of ampicillin at 30° C. Propagation of these transformants at 37° C. in liquid cultures was found to result in plasmid instability under some circumstances. Plasmid DNAs from three of the resulting transformants were analyzed by restriction endonuclease digestion and agarose gel electrophoresis and all three were found to have the structure of the expected recombinant. One plasmid was designated pDD24 and subjected to additional restriction endonuclease analysis and was employed in gene replacement experiments in *Schizochytrium* (see Example 4). The nucleotide sequence of the coding region of pDD24 is represented herein by SEQ ID NO:75. SEQ ID NO:75 encodes SEQ ID NO:74. The plasmid pDD24 was deposited as ATCC Accession No. PTA-8226, as described previously herein.

Example 4

The following example describes the expression of various Th. 23B orfC constructs described in Examples 1-3 above in *Schizochytrium*, and the analysis of PUFAs produced by such organisms.

Expression of Variant Th.23B orfC Genes in *Schizochytrium*

*Schizochytrium* strain B32-Z1 (see above and Example 8 in U.S. Patent Application Publication No. 20050100995), which is a *Schizochytrium* with an exact deletion of the *Schizochytrium* orfC coding region, was transformed with plasmid pThOrfC-synPS (full length synthetic Th.23B orfC; see Example 1), pDS49 (non-synthetic Th.23B DH2 region; see Example 2), and pDD24 (synthetic Th.23B DH2 region; see Example 3) by particle bombardment using techniques previously described (see U.S. Patent Application Publication No. 2003/0166207). Prototrophic Zeocin™-sensitive transformants were obtained. Such transformants arose from double cross-over gene replacement events as confirmed by Southern blot and/or PCR for selected strains.

Briefly, particle bombardment utilized the BioRad (Hercules, Calif.) Biolistic® PDS-1000/He Particle Delivery System. *Schizochytrium* strains for transformation were grown at 29-30° C. in M2B medium (plus DHA where appropriate) on a gyratory platform (200 rpm) to OD600=1 to 2.5 (BioPhotometer, Eppendorf). Cells were collected by centrifugation (3000 rpm, 5 min.) and re-suspended in sterile 7.5 g/L $Na_2SO_4$ to OD600=30. A 150 µL volume of suspended cells were spread in a circular patch (6 cm diameter) on a Petri plate containing M2B agar (without DHA). For growth of PUFA auxotrophs, M2B was supplemented with DHA to 0.25 mM from a stock of 25 mM DHA in 40% (w/v) randomly methylated β-cyclodextrin (CTD Inc, High Springs, Fla.). When performing bombardments for complementation of DHA auxotrophy, DHA was omitted from the agar medium. Bombardments were carried out in laminar flow hood using 1100 psi rupture discs, a 0.25 in gap between the disc retaining cap and the macrocarrier cover lid, and the stopping screen support in the middle position. The target shelf is in the L2 (6 cm) position. Petri plates containing bombarded DHA auxotrophic *Schizochytrium* strains were incubated at 29-30° C. until (prospective prototrophic) colonies develop (3-5 days). Randomly chosen colonies were streaked to M2B agar plates. After growth, several well-isolated colonies were transferred to M2B plates with and without Zeocin® (50 µg/mL). Zeocin-sensitive DHA prototrophs (suggestive of a gene replacement event) were selected for further study.

Growth of *Schizochytrium* for Fatty Acid Analysis

Erlenmeyer flasks (250 mL) containing 50 mL of M50-20 medium were inoculated with the contents (1 mL) of a cryovial of the indicated strain. The flasks were incubated at 29-30° C. on a rotating shaker at 200 rpm for 72 hours. Similar flasks containing SSFM medium were inoculated with 0.5 mL of the M50-20 culture and incubated as above for 5 days. Cells were harvested by centrifugation (4000 g, 5 min) after dilution of the broth with an equal volume of 70% isopropanol. The resulting cell pellets were suspended in an original volume of 35% isopropanol water and re-centrifuged. The washed cell pellets were immediately frozen at −70° C. followed by lyophilization. The fatty acid content of the dried biomass was determined by preparing fatty acid methyl esters (FAMEs) using acidic methanol, extracting them into hexane and analyzing by gas-liquid chromatography.

M50-20 Medium

The components per liter of M50-20 medium are as follows: 12.5 g NaCl, 2.5 g $MgSO_4.7H_2O$, 0.5 g KCl, 0.05 g $CaCl_2$, 20.0 g glucose, 20.0 g Na-glutamate, 0.4 g $KH_2PO_4$, 1.0 g yeast extract, 0.4 g $NaHCO_3$, 5 ml PII trace metals (200×PII trace metal solution contains per liter: 6.0 g $Na_2EDTA$, 0.29 g $FeCl_3.6H_2O$, 6.84 g $H_3BO_3$, 0.86 g $MnCl_2.4H_2O$, 60 mg $ZnCl_2$, 26 mg $CoCl_2.6H_2O$, 52 mg $NiSO_4.6H_2O$, 2 mg $CuSO_4.5H_2O$, and 5 mg $NaMoO_4.2H_2O$, pH 8.0), 1 ml PII vitamin mix (1000×PII vitamin mix contains per liter: 100 mg thiamin, 0.5 mg biotin, and 0.5 mg vitamin $B_{12}$), pH7.0.

SSFM Medium

The components per liter of SSFM medium are as follows: 13.62 g $Na_2SO_4$, 0.72 g $K_2SO_4$, 0.56 g KCl, 2.27 g $MgSO_4.7H_2O$, 0.19 g $CaCl_2$, 0.0565 g $KH_2PO_4$, 0.57 g $(NH_4)_2SO_4$, 0.13 g Na-glutamate, 100 mM MES (4-morpholine ethanesulfonic acid) pH 6.0, 50.0 g glucose, 0.16 mg vitamin $B_{12}$, 9.75 mg thiamin, 3.33 mg calcium pantothenate, 10.3 mg $FeSO_4.7H_2O$, 3.1 mg $MnCl_2.4H_2O$, 1.93 mg $ZnSO_4.7H_2O$, 0.04 mg $CoCl_2.6H_2O$, 0.04 mg $NaMoO_4.2H_2O$, 2.07 mg $CuSO_4.5H_2O$, 2.07 mg $NiSO_4.6H_2O$, 2.0 mg citric acid.

M2B Medium

The components of M2B medium are as follows (per liter): glucose 10 g, $(NH_4)_2SO_4$ 0.8 g, $Na_2SO_4$ 5.0 g, $MgSO_4.7H_2O$ 2.0 g, $KH_2PO_4$ 0.5 g, KCl 0.5 g, $CaCl_2.2H_2O$ 0.1 g, vitamin $B_{12}$ 0.05 mg, thiamine.HCl, 0.2 mg, calcium pantothenate 0.2 mg, $FeSO_4.7H_2O$ 3.0 mg, $MnCl_2.4H_2O$ 1.0 mg, $ZnSO_4.7H_2O$ 0.8 mg, $CoCl_2.6H_2O$ 0.02 mg, $Na_2MoO_4.2H_2O$ 0.01 mg, $CuSO_4.5H_2O$ 0.6 mg, $NiSO_4.6H_2O$ 0.8 mg, MES buffer 0.1M, pH 6.0 (adjusted with NaOH).

PUFA Analysis of Recombinant *Schizochytrium* Strains

Table 2 shows the total fatty acid, DHA, and DPAn-6 content (expressed as FAME (fatty acid methyl ester)) of *Schizochytrium* ATCC 20888 and derivative strains in which the native orfC coding region is replaced by all or part of the orfC coding region of *Thraustochytrium* 23B (described in Examples 1-3). Replacement of the entire *Schizochytrium* ATCC 20888 orfC coding region with that from Th.23B (strain B34-1) results in a higher DHA/DPAn-6 ratio (closer to that of Th.23B) but less total PUFA content. That protein expression is the likely cause of lower total PUFA content is demonstrated by use of the codon-optimized (synthetic) Th.23B orfC coding region (e.g., in strain B67-5; transformed with pThOrfC_syn-PS) in which PUFA production is increased over wild-type levels while the enhanced DHA/

DPAn-6 ratio is maintained. Substitutions of just the *Schizochytrium* DH2 region with that of *Thraustochytrium* show a similar pattern. The strain with the codon-optimized Th.23B DH2 region (B69-2; transformed with pDD24) yields higher PUFA than the strain with the non-optimized DH2 region (B105-1A1; transformed with pDS49). However, the DHA/DPA ratio in strain B105-1A1 (non-optimized DH2 region) was notably high.

Interestingly, strain B69-6 produces high levels of DHA and a relatively high DHA/DPA ratio. This strain resulted from the same transformation of strain B32-Z1 with plasmid pDD24 that produced strain B69-2. However, strain B69-6 does not have a correct integration/gene replacement of the modified orfC coding region (as determined by PCR analysis), although the exact nature of the discrepancy is not known.

Given these data, production-scale fermentations can be developed with strain B69-2 to achieve maximal DHA production, or strains B69-6 or B105-1A1 if the greatest DHA/DPA ratio is desired.

TABLE 2

Summary of orfC Variants

| Strain | FAME (% dcw) | DHA (% dcw) | DPAn-6 (% dcw) | DHA (% FAME) | DHA/DPA | strain description |
|---|---|---|---|---|---|---|
| ATCC20888 | 71.4 | 16.5 | 3.64 | 22.9 | 4.5 | wild type *Schizochytrium* |
| B34-1 | 78.4 | 13.4 | 1.24 | 17.0 | 10.8 | (non-synth.) Th.23B orfC |
| B67-5 | 73.0 | 21.3 | 1.85 | 28.9 | 11.5 | synth. Th.23B orfC |
| B105-1A1 | 73.5 | 19.4 | 1.31 | 26.4 | 14.8 | (non-synth.) Th.23B DH2 |
| B69-2 | 73.0 | 23.0 | 2.31 | 31.6 | 10.0 | synth. Th.23B DH2 |
| B69-6 | 73.8 | 22.4 | 1.76 | 30.3 | 12.7 | synth. Th.23B DH2 |

Dcw dry cell weight
FAME fatty acid methyl ester
Th.23B *Thraustochytrium* sp. 23B; ATCC20892

Example 5

The following example describes the production of DHA and DPA in *E. coli* by a multi-plasmid system, and further illustrates that the DH2 domain of the PUFA PKS system controls the ratio of fatty acid production by the system.

The inventors have previously demonstrated production of DHA and DPA in *E. coli* by the use of T7 inducible system to express OrfA, OrfB*, OrfC from *Schizochytrium* and HetI from *Nostoc* (Example 3, page 41, U.S. Patent Application Publication No. 20050100995). In this previous example, OrfA, OrfB* and OrfC were contained on a single plasmid. In order to create a system more amenable to genetic manipulation, the individual coding regions from *Schizochytrium* were cloned on a set of compatible expression plasmids designed for the coexpression of multiple target genes. The expression of the target genes is similarly driven by the inducible T7 promoter on this Duet series of plasmids (Novagen). *Schizochytrium* orfA was cloned as an NdeI-XbaI fragment from pBR115L1 into the expression vector pETDuet-1 to create pREZ91 (pBR115L1 is referenced in the generation of the final expression plasmid in Example 3, page 41, U.S. Patent Application Publication No. 20050100995). *Schizochytrium* orfB* was cloned as an NdeI-XbaI fragment from pJK780 into the expression vector pCDFDuet-1 to create pREZ96 (pJK780 is referenced in the generation of the final expression plasmid in Example 3, page 41, U.S. Patent Application Publication No. 20050100995). *Schizochytrium* orfC was cloned as an NdeI-XbaI fragment from pJK510 into pColADuet-1 to create pREZ101 (pJK510 is referenced in the generation of the final expression plasmid in Example 3, page 41, U.S. Patent Application Publication No. 20050100995). The required accessory gene hetI, encoding a phosphopantetheine transferase (PPTase), was supplied on a pACYC184-based plasmid pJK737 previously described (Example 3, page 41, U.S. Patent Application Publication No. 20050100995). OrfA, OrfB*, OrfC and hetI, contained separately on plasmids pREZ91, pREZ96, pREZ101 and pJK737 respectively, were transformed into *E. coli* stain BLR (DE3) (Novagen) which contains an inducible T7 RNA polymerase.

Production of DHA and DPA was detected in *E. coli* cells grown in Luria Broth (LB) at both 25° C. and 30° C. (see Table 3 below) using these multi-plasmid strains. Single colonies were inoculated into LB broth supplemented with antibiotics to maintain each plasmid in the given strain and grown overnight at the desired temperature (25° C. or 30° C.). Volumes of 300 µL of these cultures were then used to inoculate main cultures of 30 mL LB with appropriate antibiotics. The main cultures were grown at the indicated temperature until OD600 (BioPhotometer, Eppendorf) was between 0.45 and 0.55, at which point the cultures were induced with IPTG to a final concentration of 1 mM. The cultures were then maintained under these expression conditions for 24 hours after which the cells were collected by centrifugation and prepared for FAME analysis. The typical level of PUFA produced (as percentages of total FAME) at 30° C. was 10% DHA and 6% DPA (16% total PUFA) for the strain carrying *Schizochytrium* orfC. The DHA/DPA ratio of 1.7 approximates that seen in *Schizochytrium* (see Table 2 below).

The expression of the *Schizochytrium* genes required for DHA and DPA production in *E. coli* on separate plasmids provided the inventors with the ability to more easily study and manipulate PUFA biosynthetic genes. As described in U.S. Patent Application Publication No. 2005/0100995, Example 8, it was demonstrated that in *Schizochytrium*, the replacement of orfC with the homologous gene from *Thraustochytrium* 23B altered the PUFAs profile with a shift in the DHA to DPA ratio. The similar experiment was carried out with the *E. coli* multi-plasmid expression system described above, in which the *Schizochytrium* orfC expression plasmid (pREZ101) was replaced with a similar *Thraustochytrium* 23B orfC expression plasmid (pREZ142).

To create pREZ142, the Th.23B orfC coding region from pREZ31 was cloned as an NcoI/SalI fragment into the Duet vector pColADuet-1. Plasmid pREZ31 is a variant of pREZ33, the "perfect stitch" gene replacement vector (described in Example 1 above and in Example 8 of U.S. Patent Application Publication No. 2005/0100995), in which a BamHI restriction site (underlined below) was engineered just upstream of the start ATG (lower case below). This engineering fortuitously created in pREZ31 an NcoI restriction site (italicized below) containing the start ATG which was composed of the last two bases of the BamHI site and the first four bases of the Th.23B orfC coding region:

<u>GGATCC</u>atgG        (SEQ ID NO: 86)

The SalI restriction site used in this cloning is native to the *Schizochytrium* orfC downstream region and is about 250 bp downstream of the TAA stop codon. This replacement in the *E. coli* expression system or the Th.23B orfC for the *Schizochytrium* orfC resulted in an altered PUFA profile with a shift of the DHA to DPA ratio from 1.5 to 6.8 and the total amount of DHA+DPA was reduced from 10% to 4% when strains were grown and induced at 25° C. (see Table below).

Hybrid orfC coding regions were generated in order to determine the region or domain of the gene responsible for control the ratio of DHA to DPA. The hybrid orfC in the expression plasmid pREZ179 contains a central DH2 region derived from *Thraustochytrium* 23B orfC and is flanked upstream and downstream by *Schizochytrium* orfC sequences (see Example 2). When pREZ179 was expressed in the above system in place of pREZ101, a DHA to DPA ratio of 6.5 was seen, while the total PUFA amount was 9% when expressed and induced at 25° C. (see Table below). This shift in DHA to DPA ratio in the *E. coli* model expression and maintenance of yield indicated that the central DH2 region of orfC controls the most or all of the ratio of DHA to DPA in PUFA biosynthesis. When this construct was then modified with additional flanking DNA and transformed into *Schizochytrium* to replace the native orfC, a similar shift in DHA to DPA ratio was seen as well as no decrease in production (see Example 4). Similarly when the hybrid orfC was expressed in a yeast system, a shift in DHA to DPA ratio was again seen (see Example 6).

TABLE 3

| orfC form (temperature) | orfC plasmid | DHA + DPA | DHA/DPA |
|---|---|---|---|
| *Schizochytrium* (30°) | pREZ101 | 16% | 1.7 |
| *Schizochytrium* (25°) | pREZ101 | 10% | 1.5 |
| Th.23B (25°) | pREZ142 | 4% | 6.8 |
| Th.23B DH2 (25°) | pREZ179 | 9% | 6.5 |

Use of Multiple Expression Plasmid System

The above examples, in which the *E. coli* and yeast multi-plasmid expression model systems were used to elucidate the role of orfC and, in particular, the DH2 region, in controlling DHA to DPA ratio in PUFA biosynthesis, demonstrates the utility of these heterologous systems. The results seen in *E. coli* and yeast parallel those seen in *Schizochytrium* in terms of relative effect of the orfC source on DHA/DPA ratio. In a similar manner, the multi-plasmid expression model systems in *E. coli* and yeast are described herein to investigate and engineer other aspects of PUFA biosynthesis including PUFA chain length, degree of fatty acid saturation, and positioning of double bonds. These systems will also allow for the easy expression of genes involved in other types of fatty acid modification such as hydroxylation and glycoslylation. In a similar manner, other PUFA biosynthetic genes from a single organism (as has been done for the *Shewanella japonica* cluster described in Example 2, U.S. Patent Application Publication No. 2005/0100995) or from more than one organism can be cloned into this *E. coli* system to facilitate study.

Example 6

The following example describes the method by which *Schizochytrium*'s PUFA synthase subunits A, B and C and *Nostoc* hetI were expressed in yeast, and further illustrates that the DH2 domain of the PUFA PKS system controls the ratio of fatty acid production by the system.

Part A

Preliminary expression experiments indicated that *Schizochytrium* OrfC and Het I could be produced as full length proteins in yeast using the native coding regions. In contrast, expression of the native coding regions for *Schizochytrium* OrfsA and B did not result in production of detectable amounts of the expected proteins. The problem seemed to be associated with the translation of the mRNA. (Northern blots showed the presence of mRNAs of the correct size.) Accordingly, synthetic versions of those two coding regions were made with the goal of improving their expression in yeast. The amino acid sequences of the proteins encoded by the synthetic genes are identical to those encoded by the native genes (i.e., SEQ ID NO:2 and SEQ ID NO:4). Initial gene design and complete gene synthesis of orfA and orfB were conducted by Blue Heron Biotechnology, Inc. (Bothell, Wash.). Codon optimization took into consideration the codon preferences of *S. cerevisiae*. The complete sequences of the synthetic coding regions (designated; sOrfA and sOrfB) are listed as SEQ ID NO:35 (sOrfA) and SEQ ID NO:36 (sOrfB). Each synthetic coding region was appended as follows with DNA to facilitate cloning in the yeast transformation vectors:

upstream sequence (SEQ ID NO: 87)
AAGCTTGTGCAGTCAAGTGCGCAAAACC<u>ATG</u> downstream sequence (SEQ ID NO: 88)
<u>TAA</u>CCCGGGTCTAGA.

The start and stop codon positions are underlined and the restriction enzyme recognition sites for HindIII (upstream) and XbaI (downstream) are shown in bold.

The *S. cerevisiae* strain InvSC1 (MATa his3-Δ1, leu2, trp1-289, ura3-52) (Invitrogen, Carlsbad, Calif.) was used for these experiments. The strain was maintained and transformed as per supplier's recommendations. Transformants were grown on glucose solid medium, raffinose broth and galactose induction medium as per the manufacturer's instructions (Invitrogen). All yeast media components were purchased from Q-BIOgene (Carlsbad, Calif.).

The *Schizochytrium* PUFA synthase genes and hetI were cloned into the following transformation vectors: pYES-Leu* (sOrfA; SEQ ID NO:35), pYES3-Tryp (sOrfB; SEQ ID NO:36), pYES2/CT (OrfC; SEQ ID NO:5) and pYES-His* (hetI; SEQ ID NO:33). Creation of these vectors is described in detail below. Some of the vectors and genes were modified to accommodate specific cloning and expression requirements (described in detail below). Appropriate selection media were used, depending on the particular experiment. The genes were cloned in each case behind GAL1 promoter and expression was induced by re-suspension of washed cells in media containing galactose according to guidelines provide by Invitrogen. Cells were grown at 30° C. and harvested (by centrifugation) at the indicated times after being transferred to the induction medium. The cell pellets were freeze dried and FAMEs were prepared using acidic methanol, extracted into hexane, and analyzed by GC.

sOrfA expression construct: The sOrfA was cloned into a customized vector, pYES-Leu/CT, constructed as follows. A pYES6/CT vector (Invitrogen) was modified by replacing a region of its DNA containing a blasticidin resistance gene with a segment of DNA containing a leu2 gene (for selection on media lacking leucine). The blasticidin gene was removed by digesting pYES6/CT with BglII and NheI and gel purifying the resulting ~4913 bp vector fragment. The leu2 gene was obtained from the yeast vector pRS425 (ATCC 77106, GenBank # U03452). The primers PO-Leu5' (SEQ ID NO:89) and PO-Leu3' (SEQ ID NO:90) were used in a PCR reaction with pRS425 as template to generate an ~1812 bp DNA fragment (from bp 664 to 2475 of pRS425) which contains the leu2 gene.

```
PO-Leu5'    GACTGCTAGCTTAAGCAAGGATTTTCTTAAC

PO-Leu3'    GACTGGATCCTCCTGATGCGGTATTTTCTCC
```

Restriction enzyme recognition sites were incorporated into the primers to facilitate cloning (5' NheI and 3' BamHI underlined). The PCR fragment was digested with BamHI and NheI and ligated to the 4913 bp vector fragment obtained from the pYES6/CT BglII/NheI digest to form pYES6-Leu. This vector was digested with HindIII and XbaI in preparation for insertion of sOrfA. The plasmid from Blue Heron containing the sOrfA and appropriate flanking DNA was digested with HindIII and XbaI. The 8.8 kb fragment with the complete sOrfA was gel purified and ligated to the prepared pYES6-Leu vector to form pBR882 (pYES6-Leu:sOrfA).

sOrfB expression construct: The inventors wished to clone the sOrfB into the pYES3 yeast expression vector which has a tryptophan selection marker. Since the pYES3 vector contains a second XbaI restriction site (the second site is in the trp1 gene), that restriction enzyme could not conveniently be used for introduction of the sOrfB DNA fragment. The region containing the XbaI site downstream of the sOrfB was modified to introduce a unique NotI site (also available as a gene insertion cloning site in pYES3) as follows. The plasmid containing the sOrfB fragment from Blue Heron was digested with HindIII and XbaI and the resulting 6.2 kb fragment of interest was gel purified. That fragment was ligated into pYES2/CT (Invitrogen) which had been cut with those same enzymes, yielding the plasmid pBR879. This plasmid was opened by cutting at the unique XbaI site. The self complementary oligo linker 5'-CTAGGCGGCCGC-3' (SEQ ID NO:91) was used to create a unique NotI site (underlined; it also eliminated the XbaI site). This yielded the plasmid pJK894. This construct was digested with HindIII and NotI and the resulting 6.2 kb fragment of interest was gel purified. That fragment was ligated into pYES3/CT (Invitrogen) which had been cut with those same enzymes to form pJK908 (pYES3:sOrfB).

OrfC expression construct: The native orfC had previously been cloned in a bacterial expression vector, and this served as the source for the gene for yeast expression. The bacterial vector was pBluescript II KS (Stratagene), and the coding region plus flanking DNA was cloned into the EcoRI (5') and XbaI (3') sites of the vector. The insert DNA included an NdeI restriction site as part of the ATG initiation codon and the TAA stop codon just prior to the XbaI site. A bacterial ribosomal binding site sequence was included in the region between the EcoRI site and the NdeI site containing the initiation codon. Prior to cloning in the yeast vector, the ribosome binding site DNA was removed and replaced with DNA appropriate for expression in the yeast system. The pBluescript plasmid harboring orfC was digested with EcoRI and NdeI and ligated to the oligonucleotide linkers FL5' (AATTCAA) and FL3' (TATTG). The resulting plasmid (designated pKCFL) was digested with HindIII (just upstream of the EcoRI site in the pBluescript KS polylinker) and XbaI to liberate an ~4526 bp fragment. This fragment was ligated to HindIII/XbaI-digested pYES2/CT to generate: pYES2/OR-FCwt (pYES2:OrfC).

HetI construct: The hetI gene from *Nostoc*, encoding a PPTase, was cloned into a customized vector, pYES6-His/CT, which was constructed as follows. A pYES6/CT vector (Invitrogen) was modified by replacing a region of its DNA containing a blasticidin resistance gene with a segment of DNA containing a his3 gene (for selection on media lacking histidine). The blasticidin gene was removed by digesting pYES6/CT with BglII and NheI and gel purifying the resulting ~4913 bp vector fragment. The his3 gene was amplified from the yeast vector pRS423 (ATCC 77104, GenBank # U03454) using the primers PO-His5' (SEQ ID NO:92) and PO-His3 (SEQ ID NO:93).

```
PO-His5'    GACTACTAGTCTAAGAAACCATTATTATCAT

PO-His3'    GACTGGATCCAGCTTTAAATAATCGGTGTCA
```

This generated an ~1251 bp region of the pRS423 plasmid that contained the his3 gene. Restriction enzyme recognition sites were incorporated into the primers to facilitate cloning (5' SpeI, and 3' BamHI, underlined). The PCR fragment was digested with SpeI and BamHI and ligated to the ~4913 bp vector fragment obtained from pYES6/CT to form pYES6-His. This vector was digested with BamHI and XbaI in preparation for insertion of the hetI gene.

The hetI gene had previously been cloned and used with the *Schizochytrium* PUFA synthase genes for PUFA production in *E. coli* (U.S. Patent Application Publication No. 20040235127, Example 2). As indicated in that application, there are no methionine codons present in the open reading frame, but there are several potential alternative start codons (TTG and ATT) near the 5' end (Black and Wolk, 1994, JBC 176, 2282-2292). PCR was used to amplify the Orf from *Nostoc* genomic DNA. The 5' primer was designed so that the first T of the furthest 5' TTG codon was replaced with an A to create a methionine codon (ATG). The 3' primer included the TGA stop codon. The amplified region extended from the bp 3994 to 3282 of the *Nostoc* nucleotide sequence deposited as GenBank # L22883 (with nucleotide 3994 being the second T of the TTG codon altered to form the ATG codon). This amplified hetI Orf was cloned in a pACYC184 vector along with flanking regulatory elements for expression in *E. coli*. This clone of the hetI Orf was used as template DNA to amplify the gene in preparation for cloning into pYES6-His. The primers HetI 5' (SEQ ID NO:94) and HetI 3' (SEQ ID NO:95) were used to create a 740 bp fragment containing the hetI Orf.

```
HetI 5'
GACTGGATCCGCCACCATGTTGCAGCATACTTGGCTACCAAAACCC

HetI 3'
GACTTCTAGATCAATAATGCCAGAATTTTGGCTGC
```

Restriction enzyme recognition sites were incorporated into the primers to facilitate cloning (5' BamHI and 3' XbaI, underlined). The ATG methionine start codon (5' primer) and the TGA stop codon (shown as the reverse TCA triplet in the 3' primer) are shown in bold. The PCR product was digested with BamHI and XbaI and ligated into the previously prepared pYES6-His vector to form pYES-His/Het/CT (pYES6-His:HetI).

Results of expressing pYES6-Leu:sOrfA, pYES3:sOrfB, pYES2:OrfC and pYES6-His:HetI in yeast.

FIG. 7 shows a comparison of GC profiles of FAMEs derived from yeast cells expressing the *Schizochytrium* PUFA synthase system (sOrfA, sOrfB, OrfC and hetI) and one obtained from control cells (lacking the sOrfA gene), such yeast strains denoted herein as strains BRY4.5 and BRY3.3, respectively. Cells were collected ~20 hrs after induction. It can be seen that two novel FAME peaks have appeared it the profile of the strain expressing the complete PUFA synthase system. These two peaks were identified as DPAn-6 and DHA by comparison of the elution time with authentic standards and subsequently by MS analyses. As predicted from our characterization of the *Schizochytrium* PUFA synthase, aside from DHA and DPAn-6, no other novel peaks are evident in the profile. FIG. 8 shows the region of the GC chromatogram of FIG. 8 which contains the PUFA FAMEs. Both the control cells and the cell expressing the PUFA synthase contain a peak that elutes near the DHA FAME. This has been identified as C26:0 FAME (by Mass Spectrum analysis) and is likely derived from sphingolipids. Although it elutes close to the DHA peak, the resolution is sufficient so that it does not interfere with the quantitation of DHA. The DPAn-6 peak is well separated from other endogenous yeast lipids in the FAME profile. In this particular example of strain BRY4.5, the cells expressing the *Schizochytrium* PUFA synthase system accumulated 2.4% DHA and 2.0% DPAn-6 (as a percentage of the total FAMEs; see Table 4 below). The sum of DHA and DPAn-6 is 4.4% of the measured fatty acids in the cells. The ratio of DHA to DPAn-6 observed in the cells was ~1.2:1.

The results presented above showing expression of the *Schizochytrium* PUFA synthase in yeast provide a confirmation of the pathway proposed in the previous applications as well as the predictions in terms of the alterations to the fatty acid profiles that can be expected in yeast and also in plants.

Part B

Expression of *Schizochytrium*'s PUFA synthase Orfs A, B and *Nostoc* Het I in yeast in combination with a hybrid gene encoding a OrfC containing a DH2 region derived from the orfC homolog of *Thraustochytrium* 23B, and the effects on the PUFAs produced in those cells.

Expression of hybrid *Schizochytrium*/Th.23B OrfC genes in yeast: As described in other sections of this application, the inventors have discovered that the main determinants of the ratio of n-3 to n-6 PUFA products of PUFA synthases reside in the OrfC protein and more specifically in the DH2 region of that protein. Gene replacement experiments in both *E. coli* and in *Schizochytrium* using the OrfC homolog derived from Th.23B in combination with the *Schizochytrium*-derived PUFA synthase genes resulted in alteration of the DHA to DPAn-6 ratio produced by those mixed systems. In *E. coli*, the products of the PUFA synthase accumulate as free fatty acids with presumably no influence on the accumulation of the primary products of the enzyme by lipid synthesis enzymes of the host organism. In *Schizochytrium*, the PUFA products accumulate in the esterified lipids, but the endogenous lipid synthesis enzymes are likely to be able to readily accommodate both DHA and DPAn-6 since those are major components of the lipid fraction of the unmodified host. Expression of the mixed PUFA synthase system in yeast would provide a model for heterologous eukaryotic hosts (e.g., plants).

Attempts to express the non-synthetic or fully synthetic Th.23B orfC genes in yeast were unsuccessful, as the expected proteins could not be detected. In contrast, expression of the hybrid orfC constructs (described below) resulted in production of active proteins.

Hybrid *Schizochytrium*/Th.23B OrfCs in pYES2: The plasmid containing the native *Schizochytrium* orfC, pYES2: OrfC (described above), was digested with BsiWI and PmlI to remove the section of DNA encoding the DH2 region and some flanking DNA. The region removed was from ~1179 bp (the BsiWI site) to ~3256 bp (the PmlI site) of the *Schizochytrium* orfC sequence (SEQ ID NO:5). The resulting 8.4 kb fragment (containing the vector as well as the 5' and 3' portions of orfC) was gel purified. A previously described plasmid (see Example 2) containing a hybrid *Schizochytrium* Th.23B orfC (pREZ179=pColA DUET-Schizo. orfC-Th.23B DH2 hybrid) was digested with BsiWI and PmlI and a 2 kb fragment containing the Th.23B DH2 region and flanking *Schizochytrium* DNA was gel purified. The two purified fragments were ligated together to form pYES2: OrfC-23BDH2.

A similar strategy was used to create pYES2: OrfC-s23BDH2. In this case the plasmid used as the source for the synthetic Th.23B DH2 region (pDD22; see Example 3) was a hybrid orfC in which the DNA encoding the Th.23B DH2 domain was derived from a synthetic coding region whose codons had been modified to more closely match the preferences of *Schizochytrium* (see Example 3).

Results of expressing pYES6-Leu:sOrfA, pYES3:sOrfB, pYES6-His:HetI and pYES2:OrfC-23BDH2 or pYES2: OrfC-s23BDH2 in yeast: Table 4 shows the PUFAs produced in yeast expressing hybrid Orf C constructs in conjunction with the *Schizochytrium* subunits A and B and *Nostoc* HetI. As observed above in part A, the only novel peaks detected in these yeast samples were DHA and DPAn-6. Growth conditions and sample preparation were as described above. Only the relevant PUFA data are shown (as FAMEs given as area %). Samples labeled as BRY4.21 contain the hybrid orfC with the native Th.23B DH2 region, while the sample labeled BRY4.23 contains the hybrid orfC with the Th.23B DH2 region derived from the synthetic gene. Two samples (a and b, from independent isolates) were tested for the BRY4.21 strain while one isolate of the BRY4.23 strain was tested. Relative to the cells expressing the *Schizochytrium* orfC, those cells expressing either form of the hybrid orfC have a higher DHA/DPAn-6 ratio (an average of ~2.6 for those with the native Th.23B DH2 and a value of ~2.9 for the sample with synthetic Th.23B DH2). The expression of the hybrid orfC gene in yeast clearly resulted in an increase in the DHA to DPAn-6 ratio relative to yeast expressing the native *Schizochytrium* orfC gene. The fact that the DHA/DPAn-6 ratio in Th.23B cells or in *Schizochytrium* expressing the hybrid orfC is much higher (~8-10) indicates that other factors are contributing to the bias towards accumulation of DHA over DPAn-6. The observation that the ratio did increase in yeast indicates that this construct is a useful model for expressing a PUFA synthase system in heterologous eukaryotic hosts (e.g., yeast or plants).

TABLE 4

| Strain | orfC form | DHA | DPAn-6 | DHA + DPA | DHA/DPA |
|---|---|---|---|---|---|
| BRY 4.5 | Schizo. | 2.4 | 2.0 | 4.4 | 1.2 |
| BRY 4.21a | Th.23B DH2 | 4.30 | 1.51 | 5.81 | 2.85 |
| BRY 4.21b | Th.23B DH2 | 4.36 | 1.67 | 6.03 | 2.61 |
| BRY 4.23 | synth. Th.23B DH2 | 2.71 | 0.92 | 3.63 | 2.95 |

Example 7

The following example demonstrates the production of PUFAs in fermentation scale experiments using various genetically modified *Schizochytrium* strains described in Example 4.

Experiment 1

Using 2-liter fermentors under typical fermentation conditions, two cultures of a wild-type *Schizochytrium* (ATCC 20888) and two cultures of a transgenic *Schizochytrium* (B67-5, having a codon-optimized (synthetic) Th.23B orfC coding region in place of the native *Schizochytrium* orfC coding region; see Example 4) were cultivated to compare the fatty acid profiles. Each strain was fermented in a medium containing carbon, nitrogen, phosphorus, salts, trace metals, and vitamins. Each fermentor was inoculated with a typical seed culture, then cultivated for 80 hours, and fed both a carbon source and a nitrogen source during cultivation. The nitrogen source was fed and consumed only during the growth phase, while the carbon source was fed and consumed throughout the fermentation. After 80 hours, samples from each fermentor were centrifuged, lyophilized and analyzed by gas chromatography for fatty acid content.
Typical fermentation conditions:
Temperature: 28-30° C.
pH: 5.0-7.5
agitation: 100-300 cps
airflow: 0.25-2.0 vvm
glucose: 5-35 g/L (concentration)
inoculum: 7.5%-15%
The results were as shown in Table 5 below:

TABLE 5

| | Strain | | | |
|---|---|---|---|---|
| | Wild-type 20888 | Wild-type 20888 | Transgenic B67-5 | Transgenic B67-5 |
| | | | log hour | |
| | 80 | 80 | 80 | 80 |
| | | | fermentor | |
| | BN25 | BN28 | BN26 | BN27 |
| % 10:0 | 0.02 | 0.01 | 0.01 | 0.01 |
| % 12:0 | 0.20 | 0.18 | 0.20 | 0.20 |
| % 13:0 | 0.00 | 0.00 | 0.07 | 0.00 |
| % 14:0 | 9.57 | 8.89 | 9.76 | 9.80 |
| % 16:0 | 33.68 | 32.58 | 34.62 | 34.51 |
| % 16:1 | 0.13 | 0.12 | 0.18 | 0.17 |
| % 17:0 | 0.08 | 0.09 | 0.07 | 0.07 |
| % 18:0 | 0.78 | 0.76 | 0.77 | 0.76 |
| % 18:1 n-9 | 0.00 | 0.00 | 0.08 | 0.08 |
| % 18:1 n-7 | 0.14 | 0.12 | 0.11 | 0.11 |
| % 18:3 n-6 | 0.14 | 0.15 | 0.08 | 0.08 |
| % 18:3 n-3 | 0.03 | 0.04 | 0.08 | 0.08 |
| % 20:0 | 0.09 | 0.08 | 0.08 | 0.08 |
| % 20:3 n-6 | 0.32 | 0.33 | 0.09 | 0.09 |
| % 20:4 ARA | 0.25 | 0.30 | 0.10 | 0.11 |
| % 20:5 EPA | 0.36 | 0.38 | 0.60 | 0.60 |
| % 22:5 n-6 | 14.98 | 15.37 | 6.52 | 6.52 |
| % 22:5 n-3 | 0.00 | 0.00 | 0.21 | 0.21 |
| % 22:6 DHA | 37.32 | 38.64 | 44.47 | 44.58 |
| DHA/DPA | 2.49 | 2.51 | 6.82 | 6.84 |

As shown in Table 5, strain B67-5 containing the synthetic *Thraustochytrium* 23B orfC coding region in place of the native *Schizochytrium* coding region produced more DHA and had a greater ration of DHA to DPAn-6 than the wild-type *Schizochytrium* strain.

Experiment 2

Using 10-liter fermentors under typical fermentation conditions, one culture of a wild-type *Schizochytrium* (ATCC 20888) and one culture of transgenic *Schizochytrium* (B105-1A1; containing a non-codon-optimized (*Thraustochytrium* native) Th.23B DH2 coding region in place of the native *Schizochytrium* DH2 region; see Example 4) were cultivated to compare the fatty acid profiles. Each strain was grown in a medium containing carbon, nitrogen, phosphorus, salts, trace metals, and vitamins. Each fermentor was inoculated with a typical seed culture, then cultivated for 72 hours, and fed both a carbon source and a nitrogen source during cultivation. The nitrogen source was fed and consumed only during the growth phase, while the carbon source was fed and consumed throughout the fermentation. After 72 hours, samples from each fermentor were centrifuged, lyophilized and analyzed by gas chromatography for fatty acid content.
Typical fermentation conditions:
Temperature: 28-30° C.
pH: 5.0-7.5
agitation: 100-300 cps
airflow: 0.25-2.0 vvm
glucose: 5-35 g/L (concentration)
inoculum: 7.5%-15%
The results are shown in Table 6.

TABLE 6

| | Strain | |
|---|---|---|
| | Wild-type 20888 | Transgenic B105-1A-1 |
| | Log Hour | |
| | 72 | 72 |
| | Vessel | |
| | BN23 | BN24 |
| % 10:0 | 0.00 | 0.00 |
| % 12:0 | 0.26 | 0.28 |
| % 13:0 | 0.09 | 0.10 |
| % 14:0 | 11.36 | 12.39 |
| % 16:0 | 37.10 | 40.02 |
| % 16:1 | 0.13 | 0.15 |
| % 17:0 | 0.07 | 0.06 |
| % 18:0 | 0.83 | 0.86 |
| % 18:1 n-9 | 0.00 | 0.11 |
| % 18:1 n-7 | 0.08 | 0.08 |
| % 18:3 n-6 | 0.13 | 0.05 |
| % 18:3 n-3 | 0.00 | 0.00 |
| % 20:0 | 0.08 | 0.10 |
| % 20:3 n-6 | 0.28 | 0.00 |
| % 20:4 ARA | 0.26 | 0.00 |
| % 20:5 EPA | 0.34 | 0.35 |
| % 22:5 n-6 | 13.48 | 4.40 |
| % 22:5 n-3 | 0.00 | 0.00 |
| % 22:6 DHA | 34.07 | 39.56 |
| DHA/DPA | 2.53 | 8.98 |

Table 6 shows that the strain comprising a *Thraustochytrium* 23B DH2 region in place of the *Schizochytrium* DH2 region has a much higher DHA/DPAn-6 ratio, again illustrating the improved DHA ratio achieved by use of chimeric PUFA PKS systems described herein.

Example 8

This example describes the construction and evaluation of all combinations of synthetic codon-optimized Th.23B orfA, orf B, and orfC coding regions expressed in *Schizochytrium*.

Detailed descriptions of methods for the exact replacement of the *Schizochytrium* orfC coding region with the Th.23B synthetic codon-optimized orfC coding region have been given above (Examples 1 and 4). Those skilled in the art recognize that these techniques can generally be applied to most genes of interest. Those skilled in the art further recognize that such gene designs and replacements can be achieved by variations on these methods or other methods altogether. For example, multiple genes/coding regions can be deleted simultaneously and replaced simultaneously. In *Schizochytrium*, the orfA and of B genes are found close together ("linked") in the genome separated by an intergenic region (comprising SEQ ID NO:76). These two coding regions (along with the intergenic region) can be simultaneously deleted by methods analogous to those described previously for orfC (U.S. Patent Application Publication No. 20050100995). Methods similar to those described in Examples 1 and 4 above can then be used to simultaneously create "perfect stitch" replacements of synthetic codon-optimized Th.23B orfA and orfB coding regions (including the entire *Schizochytrium* intergenic region) into the *Schizochytrium* orfA/orfB locus. Strains such as B80-1 and B80-20 (Table 7) were created in this way.

In another example, coding region deletions can be created by a "two-step" method in which a plasmid carrying the marked deletion structure plus a second selectable marker initially recombines in its entirety by a single cross-over event into the target locus. Then, the integrant structure "resolves" by a single cross-over event at a site on the opposite side of the deletion structure such that the second selectable marker is lost and the deletion structure remains in place of the original gene structure (Rothstein R., "Targeting, Disruption, Replacement, and Allele Rescue: Integrative DNA Transformation in Yeast", pp 281-301 in *Methods in Enzymology*, vol. 194 (1991), Elsevier/Academic Press, Amsterdam). The precursor to strain B71-1 (Table 7) was created in this manner.

By the methods outlined here, a set of *Schizochytrium* strains in which all combinations of the synthetic (codon-optimized) Th.23B orfA, orfB, and orfC coding regions have replaced the cognate *Schizochytrium* coding regions has been created. The set member containing no Th.23B genes is the wild type *Schizochytrium* ATCC20888, and the set member containing only the (full length) synthetic codon-optimized Th.23B orfC coding region, B67-5, was described in Example 4 and Table 1 above. This set of eight strains was evaluated for fatty acid production during growth in SSFM medium as described in Example 4 above, and the data are given in Table 7.

Plasmid pDD26 contains the full length synthetic Th.23B orfA coding region perfectly stitched to the upstream and downstream regions of the *Schizochytrium* orfA gene. The nucleotide sequence of the coding region of pDD26 is represented herein by SEQ ID NO:71. SEQ ID NO:71 encodes SEQ ID NO:39. pDD26 has been deposited as ATCC Accession No. PTA-8411, as described previously herein.

Plasmid pDD32 contains the full length synthetic Th.23B orfB coding region perfectly stitched to the upstream and downstream regions of the *Schizochytrium* orfB gene. The nucleotide sequence of the coding region of pDD32 is represented herein by SEQ ID NO:72. SEQ ID NO:72 encodes SEQ ID NO:52. pDD32 has been deposited as ATCC Accession No. PTA-8412, as described previously herein.

The protein products of all three synthetic codon-optimized Th.23B orf coding regions function in *Schizochytrium* and successfully interact with other PUFA synthase components regardless of source. Expression of the Th.23B OrfC protein (strain B67-5) causes an increase in the DHA/DPA ratio to a value that approximates that in the native Th.23B strain, a result previously demonstrated in Example 4. This phenomenon is seen for all combinations expressing the Th.23B OrfC protein (B67-5, B79-11, B79-1, and B80-20). Surprisingly, the combination of synthetic codon-optimized Th.23B orfC plus synthetic codon-optimized Th.23B orfA coding regions (strain B79-1) leads to the highest level of DHA production, while maintaining the high DHA/DPA ratio. The increased DHA production in this *Schizochytrium* strain appears to be due to both the increased n-3/n-6 ratio caused by Th.23B OrfC and increased total PUFA production caused by the interaction of Th.23B OrfA with Th.23B OrfC.

These data demonstrate that components of the PUFA synthase complex from different organisms can successfully co-function and can confer specific characteristics of the source organism to a new host. Furthermore, manipulation of the source and expression levels of PUFA synthase components can lead to novel profiles, higher productivities, and lower costs of target fatty acids.

TABLE 7

| strain | Th.23B orf gene(s) | FAME (% dcw) | DHA (% dcw) | DPA (% dcw) | DHA (% FAME) | DHA/DPA |
|---|---|---|---|---|---|---|
| ATCC20888 | (none) | 73.9 | 16.4 | 5.4 | 22.1 | 3.04 |
| B71-1 | A | 74.2 | 17.2 | 5.15 | 23.2 | 3.34 |
| B82-3 | B | 67.9 | 15.4 | 4.93 | 22.7 | 3.12 |
| B67-5 | C | 76.2 | 22.2 | 2.88 | 29.2 | 7.71 |
| B80-1 | AB | 77.9 | 12.8 | 3.20 | 16.4 | 4.00 |
| B79-11 | BC | 79.1 | 23.4 | 2.72 | 29.6 | 8.60 |
| B79-1 | AC | 79.0 | 31.1 | 2.90 | 39.4 | 10.72 |
| B80-20 | ABC | 77.4 | 20.9 | 2.32 | 27.0 | 9.01 |

Each reference cited herein is incorporated herein by reference in its entirety.

While various embodiments of the present invention have been described in detail, it is apparent that modifications and adaptations of those embodiments will occur to those skilled in the art. It is to be expressly understood, however, that such modifications and adaptations are within the scope of the present invention, as set forth in the following claims.

SEQUENCE LISTING (95 sequences)

SEQ ID NO: 1 - DNA, 8733 bp, Schizochytrium sp.
  CDS (1)..(8733)
atggcggcccgtctgcaggagcaaaagggaggcgagatggatacccgcattgccatcatcggcatgtcggccatcctcccctgcggcacgaccgtgcgcgagtcgtgggagaccatccgcgccggcatcgactgcctgtcggatctccccgaggaccgcgtcgacgtgacggcgtactttgaccccgtcaagaccaccaaggacaagatctactgcaagcgcggtggcttcattcccgagtacgactttgacgcccgcgagttcggactcaacatgttccagatggaggactcggacgcaaaccagaccatctcgcttctcaaggtcaaggaggccctccaggacgccggcatcgacgccctcggcaaggaaaagaagaacatcggctgcgtgctcggcattggcggcggccaaaagtccagccacgagttctactcgcgccttaattatgttgtcgtggagaaggtcctccgcaagatgggcatgcccgaggaggacgtcaaggtcgccgtcgaaaagtacaaggccaacttccccgagtggcgcctcgactccttccctggcttcctcggcaacgtcaccgccggtcgctgcaccaacaccttcaacctcgacggcatgaactgcgttgtcgacgccgcatgcgcctcgtccctcatcgccgtcaaggtcgccatcgacgagctgctctacggtgactgcgacatgatggtcaccggtgccacctgcacggataactccatcggcatgtacatggccttctccaagacccccgtgttctccacggaccccagcgtgcgcgcctacgacgaaaagacaaagggcatgctcatcggcgagggctccgccatgctcgtcctcaagcgctacgccgacgccgtccgcgacggcgatgagatccacgctgttattcgcggctgcgcctcctccagtgatggcaaggccgccggcatctacacgcccaccatttcgggccaggaggaggccctccgccgcgcctacaaccgcgcctgtgtcgacccggccaccgtcactctcgtcgagggtcacggcaccggtactcccgttggcgaccgcatcgagctcaccgccttgcgcaacctctttgacaaggcctacggcgagggcaacaccgaaaaggtcgctgtgggcagcatcaagtccagcatcggccatctcaaggccgtcgccggtctcgccggtatgatcaaggtcatcatggcgctcaagcacaagactctcccgggcaccatcaacgtcgacaacccacccaacctctacgacaacacgcccatcaacgagtcctcgctctacattaacaccatgaaccgcccctggttcccgccccctggtgtgccccgccgcgccggcatttcgagctttggctttggtggcgccaactaccacgccgtcctcgaggaggccgagcccgagcacacgaccgcgtaccgcctcaacaagcgcccgcagcccgtgctcatgatggccgccacgcccgcggccctccagtcgctctgcgaggcccagctcaaggagttcgaggccgccatcaaggagaacgagaccgtcaagaacaccgcctacatcaagtgcgtcaagttcggcgagcagttcaaattccctggctccatcccggccacaaacgcgcgcctcggcttcctcgtcaaggatgctgaggatgcctgctccaccctccgtgccatctgcgcccaattcgccaaggatgtcaccaaggaggcctggcgcctcccccgcgagggcgtcagcttccgcgccaagggcatcgccaccaacggcgctgtcgccgcgctcttctccggccagggcgcgcagtacacgcacatgtttagcgaggtggccatgaactggccccagttccgccagagcattgccgccatggacgccgcccagtccaaggtcgctggaagcgacaaggactttgagcgcgtctcccaggtcctctacccgcgcaagccgtacgagcgtgagcccgagcaggaccacaagaagatctccctcaccgcctactcgcagccctcgaccctggcctgcgctctcggtgcctttgagatcttcaaggaggccggcttcaccccggactttgccgccggccattcgctcggtgagttcgccgccctctacgccgcgggctgcgtcgaccgcgacgagctctttgagcttgtctgccgccgcgcccgcatcatgggcggcaaggacgcaccggccacccccaagggctgcatggccgccgtcattggccccaacgccgagaacatcaaggtccaggccgccaacgtctggctcggcaactccaactcgccttcgcagaccgtcatcaccggctccgtcgaaggtatccaggccgagagcgcccgcctccagaaggagggcttccgcgtcgtgcctcttgcctgcgagagcgccttccactcgccccagatggagaacgcctcgtcggccttcaaggacgtcatctccaaggtctccttccgcacccccaaggccgagaccaagctcttcagcaacgtctctggcgagacctaccccacggacgcccgcgagatgcttacgcagcacatgaccagcagcgtcaagttcctcacccaggtccgcaacatgcaccaggccggtgcgcgcatctttgtcgagttcggacccaagcaggtgctctccaagcttgtctccgagaccctcaaggatgacccctcggttgtcaccgtctctgtcaacccggcctcgggcacggattcggacatccagctccgcgacgcggccgtccagctcgttgtcgctggcgtcaaccttcagggctttgacaagtgggacgcccccgatgccacccgcatgcaggccatcaagaagaagcgcactaccctccgcctttcggccgccacctacgtctcggacaagaccaagaaggtccgcgacgccgccatgaacgatggccgctgcgtcacctacctcaagggcgccgcaccgctcatcaaggccccggagcccgttgtcgacgaggccgccaagcgcgaggccgagcgtctccagaaggagcttcaggatgcccagcgccagctcgacgacgccaagcgcgccgccgccgaggccaactccaagctcgccgctgccaaggaggaggccaagaccgccgctgcttcggccaagcccgcagttgacactgctgttgtcgaaaagcatcgtgccatcctcaagtccatgctcgcggagctcgatggctacggatcggtcgacgcttcttccctccagcagcagcagcagcagcagacggcccccgccccggtcaaggctgctgcgcctgccgcccccgttgcctcggcccctgccccggctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggcagctctgccccggcgcctgctgccgctgctccggctccggccaaggctgcccctgccgccgctgcgcctgctgtctcgaacgagcttctcgagaaggccgagaccgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgacgctctcagccgcactcgcactgtgggtgaggtcgtcaacgccatgaaggctgagatcgctggtggctctgccccggcgcctgccgccgctgccccaggtccggctgctgccgcccctgcgcctgccgccgccgcccctgctgtctcgaacgagcttcttgagaaggccgagaccgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgctgtctcgagcgagcttctcgagaaggccgagactgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgccgcccctgcgcctgctgtctcgagcgagcttctcgagaaggccgagactgtcgtcatggaggtcctcgccgccaagactggctacgagactgacatgattgagtccgacatggagctcgagaccgagctcggcattgactccatcaagcgtgtcgagattctctccgaggttcaggccatgctcaacgtcgaggccaaggacgtcgacgctctcagccgcactcgcactgttggtgaggtcgtcgatgccatgaaggctgagatcgctggcagctccgcctcggcgcctgccgccgctgctcctgctccggctgctgccgctcctgcgcccgctgccgccgcccctgctgtctcgaacgagcttctcgagaaagccgagactgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttctcgagaaggccgagactgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgatgctctcagccgcactcgcactgttggcgaggtcgtcgatgccatgaaggctgagatcgccggcagctccgccccggcgcctgccgccgctgctcctgctccggctgctgccgctcctgcgcccgctgccgctgcccctgctgtctcgagcgagcttctcgagaaggccgagaccgtcgtcatggaggtcctcgccgccaagactggctacgagactgacatgattgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttcttgagaaggccgagaccgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgacgctctcagccgcactcgcactgttggcgaggtcgtcgatgccatgaaggctgagatcgctggtggctctgccccggcgcctgccgccgctgctcctgcctcggctggcgccgcgcctgcggtcaagattgactcggtccacggcgctgactgtgatgatctttccctgatgcacgccaaggtggttgacatccgccgcccggacgagctcatcctggagcgccccgagaaccgccccgttctcgttgtcgatgacggcagcgagctcaccctcgccctggtccgcgtcctcggcgcctgcgccgttgtcctgacctttgagggtctccagctcgctcagcgcgctggtgccgctgccatccgccacgtgctcgccaaggatctttccgcggagagcgccgagaaggccatcaaggaggccgagcagcgctttggcgctctcggcggcttcatctcgcagcaggcggagcgcttcgagcccgccgaaatcctcggcttcacgctcatgtgcgccaagttcgccaaggcttccctctgcacggctgtggctggcggccgcccggcctttatcggtgtggcgcgccttgacggccgcctcggattcacttcgcagggcacttctgacgcgctcaagcgtgcccagcgtggtgccatctttggcctctgcaagaccatcggcctcgagtggtccgagtctgacgtcttttcccgcggcgtggacattgctcagggcatgcaccccgaggatgccgccgtggcgattgtgcgcgagatggcgtgcgctgacattcgcattcgcgaggtcggcattggcgcaaaccagcagcgctgcacgatccgtgccgccaagctcgagaccggcaacccgcagcgccagatcgccaaggacgacgtgctgctcgtttctggcggcgctcgcggcatcacgcctctttgcatccgggagatcacgcgccagatcgcgggcggcaagtacattctgcttggccgcagcaaggtctctgcgagcgaaccggcatggtgcgctggcatcactgacgagaaggctgtgcaaaaggctgctacccaggagctcaagcgcgcctttagcgctggcgagggccccaagcccacgccccgcgctgtcactaagcttgtgggctctgttcttggcgctcgcgaggtgcgcagctctattgctgcgattgaagcgctcggcggcaaggccatctactcgtcgtgcgacgtgaactctgccgccgacgtggccaaggccgtgcgcgatgccgagtcccagctcggtgcccgcgtctcgggcatcgttcatgcctcgggcgtgctccgcgaccgtctcatcgagaagaagctccccgacgagttcgacgccgtctttggcaccaaggtcaccggtctcgagaacctcctcgccgccgtcgaccgcgccaacctcaagcacatggtcctcttcagctcgctcgccggcttccacggcaacgtcggccagtctgactacgccatggccaacgaggcccttaacaagatgggcctcgagctcgccaaggacgtctcggtcaagtcgatctgcttcggtccctgggacggtggcatggtgacgccgcagctcaagaagcagttccaggagatgggcgtgcagatcatcccccgcgagggcggcgctgataccgtggcgcgcatcgtgctcggctcctcgccggctgagatccttgtcggcaactggcgcaccccgtccaagaaggtcggctcggacaccatcaccctgcaccgcaagatttccgccaagtccaaccccttcctcgaggaccacgtcatccagggccgccgcgtgctgcccatgacgctggccattggctcgctcgcggagacctgcctcggcctcttccccggctactcgctctgggccattgacgacgcccagctcttcaagggtgtcactgtcgacggcgacgtcaactgcgaggtgaccctcaccccgtcgacggcgccctcgggccgcgtcaacgtccaggccacgctcaagaccttttccagcggcaagctggtcccggcctaccgcgccgtcatcgtgctctccaaccagggcgcgcccccggccaacgccaccatgcagccgccctcgctcgatgccgatccggcgctccagggctccgtctacgacggcaagaccctcttccacggcccggccttccgcggcatcgatgacgtgctctcgtgcaccaagagccagcttgtggccaagtgcagcgctgtccccggctccgacgccgctcgcggcgagtttgccacggacactgacgcccatgaccccttcgtgaacgacctggcctttcaggccatgctcgtctgggtgcgccgcacgctcggccaggctgcgctccccaactcgatccagcgcatcgtccagcaccgcccggtcccgcaggacaagcccttctacattaccctccgctccaaccagtcgggcggtcactcccagcacaagcacgcccttcagttccacaacgagcagggcgatctcttcattgatgtccaggcttcggtcatcgccacggacagccttgccttctaa

SEQ ID NO: 2 - protein, 2910 aa, Schizochytrium sp.
MAARLQEQKGGEMDTRIAIIGMSAILPCGTTVRESWETIRAGIDCLSDLPEDRVDVTAYFDPVKTTKDKIYCKRGGFIPEYDFDAREFGLNMFQMEDSDANQTISLLKVKEALQDAGIDALGKEKKNIGCVLGIGGGQKSSHEFYSRLNYVVVEKVLRKMGMPEEDVKVAVEKYKANFPEWRLDSFPGFLGNVTAGRCTNTFNLDGMNCVVDAACASSLIAVKVAIDELLYGDCDMMVTGATCTDNSIGMYMAFSKTPVFSTDPSVRAYDEKTKGMLIGEGSAMLVLKRYADAVRDGDEIHAVIRGCASSSDGKAAGIYTPTISGQEEALRRAYNRACVDPATVTLVEGHGTGTPVGDRIELTALRNLFDKAYGEGNTEKVAVGSIKSSIGHLKAVAGLAGMIKVIMALKHKTLPGTINVDNPPNLYDNTPINESSLYINTMNRPWFPPPGVPRRAGISSFGFGGANYHAVLEEAEPEHTTAYRLNKRPQPVLMMAATPAALQSLCEAQLKEFEAAIKENETVKNTAYIKCVKFGEQFKFPGSIPATNARLGFLVKDAEDACSTLRAICAQFAKDVTKEAWRLPREGVSFRAKGIATNGAVAALFSGQGAQYTHMFSEVAMNWPQFRQSIAAMDAAQSKVAGSDKDFERVSQVLYPRKPYEREPEQDHKKISLTAYSQPSTLACALGAFEIFKEAGFTPDFAAGHSLGEFAALYAAGCVDRDELFELVCRRARIMGGKDAPATPKGCMAAVIGPNAENIKVQAANVWLGNSNSPSQTVITGSVEGIQAESARLQKEGFRVVPLACESAFHSPQMENASSAFKDVISKVSFRTPKAETKLFSNVSGETYPTDAREMLTQHMTSSVKFLTQVRNMHQAGARIFVEFGPKQVLSKLVSETLKDDPSVVTVSVNPASGTDSDIQLRDAAVQLVVAGVNLQGFDKWDAPDATRMQAIKKKRTTLRLSAATYVSDKTKKVRDAAMNDGRCVTYLKGAAPLIKAPEPVVDEAAKREAERLQKELQDAQRQLDDAKRAAAEANSKLAAAKEEAKTAAASAKPAVDTAVVEKHRAILKSMLAELDGYGSVDASSLQQQQQQQTAPAPVKAAAPAAPVASAPAPAVSNELLEKAETVVMEVLAAKTGYETDMIEADMELETELGIDSIKRVEILSEVQAMLNVEAKDVDALSRTRTVGEVVNAMKAEIAGSSAPAPAAAAPAPAKAAPAAAAPAVSNELLEKAETVVMEVLAAKTGYETDMIESDMELETELGIDSIKRVEILSEVQAMLNVEAKDVDALSRTRTVGEVVNAMKAEIAGGSAPAPAAAAPGPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAPAAPAPAVSSELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAPAAPAPAAPAPAVSSELLEKAETVVMEVLAAKTGYETDMIESDMELETELGIDSIKRVEILSEVQAMLNVEAKDVDALSRTRTVGEVVDAMKAEIAGSSASAPAAAAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGSSAPAPAAAAPAPAAAAPAPAAAAPAVSSELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPASAGAAPAVKIDSVHGADCDDLSLMHAKVVDIRRPDELILERPENRPVLVVDDGSELTLALVRVLGACAVVLTFEGLQLAQRAGAAAIRHVLAKDLSAESAEKAIKEAEQRFGALGGFISQQAERFEPAEILGFTLMCAKFAKASLCTAVAGGRPAFIGVARLDGRLGFTSQGTSDALKRAQRGAIFGLCKTIGLEWSESDVFSRGVDIAQGMHPEDAAVAIVREMACADIRIREVGIGANQQRCTIRAAKLETGNPQRQIAKDDVLLVSGGARGITPLCIREITRQIAGGKYILLGRSKVSASEPAWCAGITDEKAVQKAATQELKRAFSAGEGPKPTPRAVTKLVGSVLGAREVRSSIAAIEALGGKAIYSSCDVNSAADVAKAVRDAESQLGARVSGIVHASGVLRDRLIEKKLPDEFDAVFGTKVTGLENLLAAVDRANLKHMVLFSSLAGFHGNVGQSDYAMANEALNKMGLELAKDVSVKSICFGPWDGGMVTPQLKKQFQEMGVQIIPREGGADTVARIVLGSSPAEILVGNWRTPSKKVGSDTITLHRKISAKSNPFLEDHVIQGRRVLPMTLAIGSLAETCLGLFPGYSLWAIDDAQLFKGVTVDGDVNCEVTLTPSTAPSGRVNVQATLKTFSSGKLVPAYRAVIVLSNQGAPPANATMQPPSLDADPALQGSVYDGKTLFHGPAFRGIDDVLSCTKSQLVAKCSAVPGSDAARGEFATDTDAHDPFVNDLAFQAMLVWVRRTLGQAALPNSIQRIVQHRPVPQDKPFYITLRSNQSGGHSQHKHALQFHNEQGDLFIDVQASVIATDSLAF

SEQ ID NO: 3 - DNA, 6180 bp, Schizochytrium sp.
  CDS (1)..(6180)
atggccgctcggaatgtgagcgccgcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgcacgggccacgactccatttctgcgctctcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcgtgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtcacgatctcgccgctgtaccactccaagcttgtggcggaggctgaggcttgctacgctgcgctctgcaagggtgaaaagcccaagaagaacaagtttgtgcgcaagattcagctcaacggtcgcttcaacagcaaggcggaccccatctcctcggccgatcttgccagctttccgcctgcggaccctgccattgaagccgccatctcgagccgcatcatgaagcctgtcgctcccaagttctacgcgcgtctcaacattgacgagcaggacgagacccgagatccgatcctcaacaaggacaacgcgccgtcttcttcttcttcttcttcttcttcttcttcttcttcttcttctccgtcgcctgctccttcggcccccgtgcaaaagaaggctgctcccgccgcggagaccaaggctgttgcttcggctgacgcacttcgcagtgccctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctgtaa

SEQ ID NO: 4 - protein, 2059 aa, Schizochytrium sp.
MAARNVSAAHEMHDEKRIAVVGMAVQYAGCKTKDEFWEVLMNGKVESKVISDKRLGSNYRAEHYKAERSKYADTFCNETYGTLDENEIDNEHELLLNLAKQALAETSVKDSTRCGIVSGCLSFPMDNLQGELLNVYQNHVEKKLGARVFKDASHWSEREQSNKPEAGDRRIFMDPASFVAEELNLGALHYSVDAACATALYVLRLAQDHLVSGAADVMLCGATCLPEPFFILSGFSTFQAMPVGTGQNVSMPLHKDSQGLTPGEGGSIMVLKRLDDAIRDGDHIYGTLLGANVSNSGTGLPLKPLLPSEKKCLMDTYTRINVHPHKIQYVECHATGTPQGDRVEIDAVKACFEGKVPRFGTTKGNFGHTLVAAGFAGMCKVLLSMKHGIIPPTPGIDDETKMDPLVVSGEAIPWPETNGEPKRAGLSAFGFGGTNAHAVFEEHDPSNAACTGHDSISALSARCGGESNMRIAITGMDATFGALKGLDAFERAIYTGAHGAIPLPEKRWRFLGKDKDFLDLCGVKATPHGCYIEDVEVDFQRLRTPMTPEDMLLPQQLLAVTTIDRAILDSGMKKGGNVAVFVGLGTDLELYRHRARVALKERVRPEASKKLNDMMQYINDCGTSTSYTSYIGNLVATRVSSQWGFTGPSFTITEGNNSVYRCAELGKYLLETGEVDGVVVAGVDLCGSAENLYVKSRRFKVSTSDTPRASFDAAADGYFVGEGCGAFVLKRETSCTKDDRIYACMDAIVPGNVPSACLREALDQARVKPGDIEMLELSADSARHLKDPSVLPKELTAEEEIGGLQTILRDDDKLPRNVATGSVKATVGDTGYASGAASLIKAALCIYNRYLPSNGDDWDEPAPEAPWDSTLFACQTSRAWLKNPGERRYAAVSGVSETRSCYSVLLSEAEGHYERENRISLDEEAPKLIVLRADSHEEILGRLDKIRERFLQPTGAAPRESELKAQARRIFLELLGETLAQDAASSGSQKPLALSLVSTPSKLQREVELAAKGIPRCLKMRRDWSSPAGSRYAPEPLASDRVAFMYGEGRSPYYGITQDIHRIWPELHEVINEKTNRLWAEGDRWVMPRASFKSELESQQQEFDRNMIEMFRLGILTSIAFTNLARDVLNITPKAAFGLSLGEISMIFAFSKKNGLISDQLTKDLRESDVWNKALAVEFNALREAWGIPQSVPKDEFWQGYIVRGTKQDIEAAIAPDSKYVRLTIINDANTALISGKPDACKAAIARLGGNIPALPVTQGMCGHCPEVGPYTKDIAKIHANLEFPVVDGLDLWTTINQKRLVPRATGAKDEWAPSSFGEYAGQLYEKQANFPQIVETIYKQNYDVFVEVGPNNHRSTAVRTTLGPQRNHLAGAIDKQNEDAWTTIVKLVASLKAHLVPGVTISPLYHSKLVAEAEACYAALCKGEKPKKNKFVRKIQLNGRFNSKADPISSADLASFPPADPAIEAAISSRIMKPVAPKFYARLNIDEQDETRDPILNKDNAPSSSSSSSSSSSSSSSPSPAPSAPVQKKAAPAAETKAVASADALRSALLDLDSMLALSSASASGNLVETAPSDASVIVPPCNIADLGSRAFMKTYGVSAPLYTGAMAKGIASADLVIAAGRQGILASFGAGGLPMQVVRESIEKIQAALPNGPYAVNLIHSPFDSNLEKGNVDLFLEKGVTFVEASAFMTLTPQVVRYRAAGLTRNADGSVNIRNRIIGKVSRTELAEMFMRPAPEHLLQKLIASGEINQEQAELARRVPVADDIAVEADSGGHTDNRPIHVILPLIINLRDRLHRECGYPANLRVRVGAGGGIGCPQAALATFNMGASFIVTGTVNQVAKQSGTCDNVRKQLAKATYSDVCMAPAADMFEEGVKLQVLKKGTMFPSRANKLYELFCKYDSFESMPPAELARVEKRIFSRALEEVWDETKNFYINRLHNPEKIQRAERDPKLKMSLCFRWYLSLASRWANTGASDRVMDYQVWCGPAIGSFNDFIKGTYLDPAVANEYPCVVQINKQILRGACFLRRLEILRNARLSDGAAALVASIDDTYVPAEKL

SEQ ID NO: 5 - DNA, 4509 bp, Schizochytrium sp.
  CDS (1)..(4509)
atggcgctccgtgtcaagacgaacaagaagccatgctgggagatgaccaaggaggagctgaccagcggcaagaccgaggtgttcaactatgaggaactcctcgagttcgcagagggcgacatcgccaaggtcttcggacccgagttcgccgtcatcgacaagtacccgcgccgcgtgcgcctgcccgcccgcgagtacctgctcgtgacccgcgtcaccctcatggacgccgaggtcaacaactaccgcgtcggcgcccgcatggtcaccgagtacgatctccccgtcaacggagagctctccgagggcggagactgcccctgggccgtcctggtcgagagtggccagtgcgatctcatgctcatctcctacatgggcattgacttccagaaccagggcgaccgcgtctaccgcctgctcaacaccacgctcaccttttacggcgtggcccacgagggcgagaccctcgagtacgacattcgcgtcaccggcttcgccaagcgtctcgacggcggcatctccatgttcttcttcgagtacgactgctacgtcaacggccgcctcctcatcgagatgcgcgatggctgcgccggcttcttcaccaacgaggagctcgacgccggcaagggcgtcgtcttcacccgcggcgacctcgccgcccgcgccaagatcccaaagcaggacgtctccccctacgccgtcgccccctgcctccacaagaccaagctcaacgaaaaggagatgcagaccctcgtcgacaaggactgggcatccgtctttggctccaagaacggcatgccggaaatcaactacaaactctgcgcgcgtaagatgctcatgattgaccgcgtcaccagcattgaccacaagggcggtgtctacggcctcggtcagctcgtcggtgaaaagatcctcgagcgcgaccactggtactttccctgccactttgtcaaggatcaggtcatggccggatccctcgtctccgacggctgcagccagatgctcaagatgtacatgatctggctcggcctccacctcaccaccggaccctttgacttccgcccggtcaacggccaccccaacaaggtccgctgccgcggccaaatctccccgcacaagggcaagctcgtctacgtcatggagatcaaggagatgggcttcgacgaggacaacgacccgtacgccattgccgacgtcaacatcattgatgtcgacttcgaaaagggccaggactttagcctcgaccgcatcagcgactacggcaagggcgacctcaacaagaagatcgtcgtcgactttaagggcatcgctctcaagatgcagaagcgctccaccaacaagaacccctccaaggttcagcccgtctttgccaacggcgccgccactgtcggccccgaggcctccaaggcttcctccggcgccagcgccagcgccagcgccgccccggccaagcctgccttcagcgccgatgttcttgcgcccaagcccgttgcccttcccgagcacatcctcaagggcgacgccctcgcccccaaggagatgtcctggcaccccatggcccgcatcccgggcaacccgacgccctcttttgcgccctcggcctacaagccgcgcaacatcgcctttacgcccttccccggcaaccccaacgataacgaccacaccccgggcaagatgccgctcacctggttcaacatggccgagttcatggccggcaaggtcagcatgtgcctcggccccgagttcgccaagttcgacgactcgaacaccagccgcagccccgcttgggacctcgctctcgtcacccgcgccgtgtctgtgtctgacctcaagcacgtcaactaccgcaacatcgacctcgacccctccaagggtaccatggtcggcgagttcgactgccccgcggacgcctggttctacaagggcgcctgcaacgatgcccacatgccgtactcgatcctcatggagatcgccctccagacctcgggtgtgctcacctcggtgctcaaggcgcccctgaccatggagaaggacgacatcctcttccgcaacctcgacgccaacgccgagttcgtgcgcgccgacctcgactaccgcggcaagactatccgcaacgtcaccaagtgcactggctacagcatgctcggcgagatgggcgtccaccgcttcacctttgagctctacgtcgatgatgtgctcttttacaagggctcgacctcgttcggctggttcgtgcccgaggtctttgccgcccaggccggcctcgacaacggccgcaagtcggagccctggttcattgagaacaaggttccggcctcgcaggtctcctcctttgacgtgcgccccaacggcagcggccgcaccgccatcttcgccaacgcccccagcggcgcccagctcaaccgccgcacggaccagggccagtacctcgacgccgtcgacattgtctccggcagcggcaagaagagcctcggctacgcccacggttccaagacggtcaacccgaacgactggttcttctcgtgccacttttggtttgactcggtcatgcccggaagtctcggtgtcgagtccatgttccagctcgtcgaggccatcgccgcccacgaggatctcgctggcaagcacggcattgccaaccccacctttgtgcacgccccgggcaagatcagctggaagtaccgcggccagctcacgcccaagagcaagaagatggactcggaggtccacatcgtgtccgtggacgcccacgacggcgttgtcgacctcgtcgccgacggcttcctctgggccgacagcctccgcgtctactcggtgagcaacattcgcgtgcgcatcgcctccggtgaggcccctgccgccgcctcctccgccgcctctgtgggctcctcggcttcgtccgtcgagcgcacgcgctcgagccccgctgtcgcctccggcccggcccagaccatcgacctcaagcagctcaagaccgagctcctcgagctcgatgccccgctctacctctcgcaggacccgaccagcggccagctcaagaagcacaccgacgtggcctccggccaggccaccatcgtgcagccctgcacgctcggcgacctcggtgaccgctccttcatggagacctacggcgtcgtcgccccgctgtacacgggcgccatggccaagggcattgcctcggcggacctcgtcatcgccgccggcaagcgcaagatcctcggctcctttggcgccggcggcctccccatgcaccacgtgcgcgccgccctcgagaagatccaggccgccctgcctcagggcccctacgccgtcaacctcatccactcgccttttgacagcaacctcgagaagggcaacgtcgatctcttcctcgagaagggcgtcactgtggtggaggcctcggcattcatgaccctcaccccgcaggtcgtgcgctaccgcgccgccggcctctcgcgcaacgccgacggttcggtcaacatccgcaaccgcatcatcggcaaggtctcgcgcaccgagctcgccgagatgttcatccgcccggccccggagcacctcctcgagaagctcatcgcctcgggcgagatcacccaggagcaggccgagctcgcgcgccgcgttcccgtcgccgacgatatcgctgtcgaggctgactcgggcggccacaccgacaaccgccccatccacgtcatcctcccgctcatcatcaacctccgcaaccgcctgcaccgcgagtgcggctaccccgcgcacctccgcgtccgcgttggcgccggcggtggcgtcggctgcccgcaggccgccgccgccgcgctcaccatgggcgccgccttcatcgtcaccggcactgtcaaccaggtcgccaagcagtccggcacctgcgacaacgtgcgcaagcagctctcgcaggccacctactcggatatctgcatggccccggccgccgacatgttcgaggagggcgtcaagctccaggtcctcaagaagggaaccatgttcccctcgcgcgccaacaagctctacgagctcttttgcaagtacgactccttcgactccatgcctcctgccgagctcgagcgcatcgagaagcgtatcttcaagcgcgcactccaggaggtctgggaggagaccaaggacttttacattaacggtctcaagaacccggagaagatccagcgcgccgagcacgaccccaagctcaagatgtcgctctgcttccgctggtaccttggtcttgccagccgctgggccaacatgggcgccccggaccgcgtcatggactaccaggtctggtgtggcccggccattggcgccttcaacgacttcatcaagggcacctacctcgaccccgctgtctccaacgagtacccctgtgtcgtccagatcaacctgcaaatcctccgtggtgcctgctacctgcgccgtctcaacgccctgcgcaacgacccgcgcattgacctcgagaccgaggatgctgcctttgtctacgagcccaccaacgcgctctaa

SEQ ID NO: 6 - protein, 1502 aa, Schizochytrium sp.
MALRVKTNKKPCWEMTKEELTSGKTEVFNYEELLEFAEGDIAKVFGPEFAVIDKYPRRVRLPAREYLLVTRVTLMDAEVNNYRVGARMVTEYDLPVNGELSEGGDCPWAVLVESGQCDLMLISYMGIDFQNQGDRVYRLLNTTLTFYGVAHEGETLEYDIRVTGFAKRLDGGISMFFFEYDCYVNGRLLIEMRDGCAGFFTNEELDAGKGVVFTRGDLAARAKIPKQDVSPYAVAPCLHKTKLNEKEMQTLVDKDWASVFGSKNGMPEINYKLCARKMLMIDRVTSIDHKGGVYGLGQLVGEKILERDHWYFPCHFVKDQVMAGSLVSDGCSQMLKMYMIWLGLHLTTGPFDFRPVNGHPNKVRCRGQISPHKGKLVYVMEIKEMGFDEDNDPYAIADVNIIDVDFEKGQDFSLDRISDYGKGDLNKKIVVDFKGIALKMQKRSTNKNPSKVQPVFANGAATVGPEASKASSGASASASAAPAKPAFSADVLAPKPVALPEHILKGDALAPKEMSWHPMARIPGNPTPSFAPSAYKPRNIAFTPFPGNPNDNDHTPGKMPLTWFNMAEFMAGKVSMCLGPEFAKFDDSNTSRSPAWDLALVTRAVSVSDLKHVNYRNIDLDPSKGTMVGEFDCPADAWFYKGACNDAHMPYSILMEIALQTSGVLTSVLKAPLTMEKDDILFRNLDANAEFVRADLDYRGKTIRNVTKCTGYSMLGEMGVHRFTFELYVDDVLFYKGSTSFGWFVPEVFAAQAGLDNGRKSEPWFIENKVPASQVSSFDVRPNGSGRTAIFANAPSGAQLNRRTDQGQYLDAVDIVSGSGKKSLGYAHGSKTVNPNDWFFSCHFWFDSVMPGSLGVESMFQLVEAIAAHEDLAGKHGIANPTFVHAPGKISWKYRGQLTPKSKKMDSEVHIVSVDAHDGVVDLVADGFLWADSLRVYSVSNIRVRIASGEAPAAASSAASVGSSASSVERTRSSPAVASGPAQTIDLKQLKTELLELDAPLYLSQDPTSGQLKKHTDVASGQATIVQPCTLGDLGDRSFMETYGVVAPLYTGAMAKGIASADLVIAAGKRKILGSFGAGGLPMHHVRAALEKIQAALPQGPYAVNLIHSPFDSNLEKGNVDLFLEKGVTVVEASAFMTLTPQVVRYRAAGLSRNADGSVNIRNRIIGKVSRTELAEMFIRPAPEHLLEKLIASGEITQEQAELARRVPVADDIAVEADSGGHTDNRPIHVILPLIINLRNRLHRECGYPAHLRVRVGAGGGVGCPQAAAAALTMGAAFIVTGTVNQVAKQSGTCDNVRKQLSQATYSDICMAPAADMFEEGVKLQVLKKGTMFPSRANKLYELFCKYDSFDSMPPAELERIEKRIFKRALQEVWEETKDFYINGLKNPEKIQRAEHDPKLKMSLCFRWYLGLASRWANMGAPDRVMDYQVWCGPAIGAFNDFIKGTYLDPAVSNEYPCVVQINLQILRGACYLRRLNALRNDPRIDLETEDAAFVYEPTNAL

SEQ ID NO: 7 - DNA, 1500 bp, Schizochytrium sp.
  CDS (1)..(1500)
atggcggcccgtctgcaggagcaaaagggaggcgagatggatacccgcattgccatcatcggcatgtcggccatcctcccctgcggcacgaccgtgcgcgagtcgtgggagaccatccgcgccggcatcgactgcctgtcggatctccccgaggaccgcgtcgacgtgacggcgtactttgaccccgtcaagaccaccaaggacaagatctactgcaagcgcggtggcttcattcccgagtacgactttgacgcccgcgagttcggactcaacatgttccagatggaggactcggacgcaaaccagaccatctcgcttctcaaggtcaaggaggccctccaggacgccggcatcgacgccctcggcaaggaaaagaagaacatcggctgcgtgctcggcattggcggcggccaaaagtccagccacgagttctactcgcgccttaattatgttgtcgtggagaaggtcctccgcaagatgggcatgcccgaggaggacgtcaaggtcgccgtcgaaaagtacaaggccaacttccccgagtggcgcctcgactccttccctggcttcctcggcaacgtcaccgccggtcgctgcaccaacaccttcaacctcgacggcatgaactgcgttgtcgacgccgcatgcgcctcgtccctcatcgccgtcaaggtcgccatcgacgagctgctctacggtgactgcgacatgatggtcaccggtgccacctgcacggataactccatcggcatgtacatggccttctccaagacccccgtgttctccacggaccccagcgtgcgcgcctacgacgaaaagacaaagggcatgctcatcggcgagggctccgccatgctcgtcctcaagcgctacgccgacgccgtccgcgacggcgatgagatccacgctgttattcgcggctgcgcctcctccagtgatggcaaggccgccggcatctacacgcccaccatttcgggccaggaggaggccctccgccgcgcctacaaccgcgcctgtgtcgacccggccaccgtcactctcgtcgagggtcacggcaccggtactcccgttggcgaccgcatcgagctcaccgccttgcgcaacctctttgacaaggcctacggcgagggcaacaccgaaaaggtcgctgtgggcagcatcaagtccagcatcggccatctcaaggccgtcgccggtctcgccggtatgatcaaggtcatcatggcgctcaagcacaagactctcccgggcaccatcaacgtcgacaacccacccaacctctacgacaacacgcccatcaacgagtcctcgctctacattaacaccatgaaccgcccctggttcccgccccctggtgtgccccgccgcgccggcatttcgagctttggctttggtggcgccaactaccacgccgtcctcgaggaggccgagcccgagcacacgaccgcgtaccgcctcaacaagcgcccgcagcccgtgctcatgatggccgccacgcccgcg

SEQ ID NO: 8 - protein, 500 aa, Schizochytrium sp.
MAARLQEQKGGEMDTRIAIIGMSAILPCGTTVRESWETIRAGIDCLSDLPEDRVDVTAYFDPVKTTKDKIYCKRGGFIPEYDFDAREFGLNMFQMEDSDANQTISLLKVKEALQDAGIDALGKEKKNIGCVLGIGGGQKSSHEFYSRLNYVVVEKVLRKMGMPEEDVKVAVEKYKANFPEWRLDSFPGFLGNVTAGRCTNTFNLDGMNCVVDAACASSLIAVKVAIDELLYGDCDMMVTGATCTDNSIGMYMAFSKTPVFSTDPSVRAYDEKTKGMLIGEGSAMLVLKRYADAVRDGDEIHAVIRGCASSSDGKAAGIYTPTISGQEEALRRAYNRACVDPATVTLVEGHGTGTPVGDRIELTALRNLFDKAYGEGNTEKVAVGSIKSSIGHLKAVAGLAGMIKVIMALKHKTLPGTINVDNPPNLYDNTPINESSLYINTMNRPWFPPPGVPRRAGISSFGFGGANYHAVLEEAEPEHTTAYRLNKRPQPVLMMAATPA

SEQ ID NO: 9 - DNA, 1278 bp, Schizochytrium sp.
  CDS (1)..(1278)
gatgtcaccaaggaggcctggcgcctcccccgcgagggcgtcagcttccgcgccaagggcatcgccaccaacggcgctgtcgccgcgctcttctccggccagggcgcgcagtacacgcacatgtttagcgaggtggccatgaactggccccagttccgccagagcattgccgccatggacgccgcccagtccaaggtcgctggaagcgacaaggactttgagcgcgtctcccaggtcctctacccgcgcaagccgtacgagcgtgagcccgagcaggaccacaagaagatctccctcaccgcctactcgcagccctcgaccctggcctgcgctctcggtgcctttgagatcttcaaggaggccggcttcaccccggactttgccgccggccattcgctcggtgagttcgccgccctctacgccgcgggctgcgtcgaccgcgacgagctctttgagcttgtctgccgccgcgcccgcatcatgggcggcaaggacgcaccggccacccccaagggctgcatggccgccgtcattggccccaacgccgagaacatcaaggtccaggccgccaacgtctggctcggcaactccaactcgccttcgcagaccgtcatcaccggctccgtcgaaggtatccaggccgagagcgcccgcctccagaaggagggcttccgcgtcgtgcctcttgcctgcgagagcgccttccactcgccccagatggagaacgcctcgtcggccttcaaggacgtcatctccaaggtctccttccgcacccccaaggccgagaccaagctcttcagcaacgtctctggcgagacctaccccacggacgcccgcgagatgcttacgcagcacatgaccagcagcgtcaagttcctcacccaggtccgcaacatgcaccaggccggtgcgcgcatctttgtcgagttcggacccaagcaggtgctctccaagcttgtctccgagaccctcaaggatgacccctcggttgtcaccgtctctgtcaacccggcctcgggcacggattcggacatccagctccgcgacgcggccgtccagctcgttgtcgctggcgtcaaccttcagggctttgacaagtgggacgcccccgatgccacccgcatgcaggccatcaagaagaagcgcactaccctccgcctttcggccgccacctacgtctcggacaagaccaagaaggtccgcgacgccgccatgaacgatggccgctgcgtcacctacctcaagggcgccgcaccgctcatcaaggccccggagccc

SEQ ID NO: 10 - protein, 426 aa, Schizochytrium sp.
DVTKEAWRLPREGVSFRAKGIATNGAVAALFSGQGAQYTHMFSEVAMNWPQFRQSIAAMDAAQSKVAGSDKDFERVSQVLYPRKPYEREPEQDHKKISLTAYSQPSTLACALGAFEIFKEAGFTPDFAAGHSLGEFAALYAAGCVDRDELFELVCRRARIMGGKDAPATPKGCMAAVIGPNAENIKVQAANVWLGNSNSPSQTVITGSVEGIQAESARLQKEGFRVVPLACESAFHSPQMENASSAFKDVISKVSFRTPKAETKLFSNVSGETYPTDAREMLTQHMTSSVKFLTQVRNMHQAGARIFVEFGPKQVLSKLVSETLKDDPSVVTVSVNPASGTDSDIQLRDAAVQLVVAGVNLQGFDKWDAPDATRMQAIKKKRTTLRLSAATYVSDKTKKVRDAAMNDGRCVTYLKGAAPLIKAPEP

SEQ ID NO: 11 - protein, 5 aa, Schizochytrium sp.
  MISC_FEATURE (4)..(4): X = any amino acid
GHSXG

SEQ ID NO: 12 - DNA, 258 bp, Schizochytrium sp.
  CDS (1)..(258)
gctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggc

SEQ ID NO: 13 - protein, 86 aa, Schizochytrium sp.
AVSNELLEKAETVVMEVLAAKTGYETDMIEADMELETELGIDSIKRVEILSEVQAMLNVEAKDVDALSRTRTVGEVVNAMKAEIAG

SEQ ID NO: 14 - protein, 5 aa, Schizochytrium sp.
LGIDS

SEQ ID NO: 15 - protein, 21 aa, Schizochytrium sp.
APAPVKAAAPAAPVASAPAPA

SEQ ID NO: 16 - DNA, 3006 bp, Schizochytrium sp.
gcccccgccccggtcaaggctgctgcgcctgccgcccccgttgcctcggcccctgccccggctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggcagctctgccccggcgcctgctgccgctgctccggctccggccaaggctgcccctgccgccgctgcgcctgctgtctcgaacgagcttctcgagaaggccgagaccgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgacgctctcagccgcactcgcactgtgggtgaggtcgtcaacgccatgaaggctgagatcgctggtggctctgccccggcgcctgccgccgctgccccaggtccggctgctgccgcccctgcgcctgccgccgccgcccctgctgtctcgaacgagcttcttgagaaggccgagaccgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgctgtctcgagcgagcttctcgagaaggccgagactgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgccgcccctgcgcctgctgtctcgagcgagcttctcgagaaggccgagactgtcgtcatggaggtcctcgccgccaagactggctacgagactgacatgattgagtccgacatggagctcgagaccgagctcggcattgactccatcaagcgtgtcgagattctctccgaggttcaggccatgctcaacgtcgaggccaaggacgtcgacgctctcagccgcactcgcactgttggtgaggtcgtcgatgccatgaaggctgagatcgctggcagctccgcctcggcgcctgccgccgctgctcctgctccggctgctgccgctcctgcgcccgctgccgccgcccctgctgtctcgaacgagcttctcgagaaagccgagactgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttctcgagaaggccgagactgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgatgctctcagccgcactcgcactgttggcgaggtcgtcgatgccatgaaggctgagatcgccggcagctccgccccggcgcctgccgccgctgctcctgctccggctgctgccgctcctgcgcccgctgccgctgcccctgctgtctcgagcgagcttctcgagaaggccgagaccgtcgtcatggaggtcctcgccgccaagactggctacgagactgacatgattgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttcttgagaaggccgagaccgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgacgctctcagccgcactcgcactgttggcgaggtcgtcgatgccatgaaggctgagatcgctggtggctctgccccggcgcctgccgccgctgctcctgcctcggctggcgccgcgcctgcg

SEQ ID NO: 17 - DNA, 2133 bp, Schizochytrium sp.
  CDS (1)..(2133)
tttggcgctctcggcggcttcatctcgcagcaggcggagcgcttcgagcccgccgaaatcctcggcttcacgctcatgtgcgccaagttcgccaaggcttccctctgcacggctgtggctggcggccgcccggcctttatcggtgtggcgcgccttgacggccgcctcggattcacttcgcagggcacttctgacgcgctcaagcgtgcccagcgtggtgccatctttggcctctgcaagaccatcggcctcgagtggtccgagtctgacgtcttttcccgcggcgtggacattgctcagggcatgcaccccgaggatgccgccgtggcgattgtgcgcgagatggcgtgcgctgacattcgcattcgcgaggtcggcattggcgcaaaccagcagcgctgcacgatccgtgccgccaagctcgagaccggcaacccgcagcgccagatcgccaaggacgacgtgctgctcgtttctggcggcgctcgcggcatcacgcctctttgcatccgggagatcacgcgccagatcgcgggcggcaagtacattctgcttggccgcagcaaggtctctgcgagcgaaccggcatggtgcgctggcatcactgacgagaaggctgtgcaaaaggctgctacccaggagctcaagcgcgcctttagcgctggcgagggccccaagcccacgccccgcgctgtcactaagcttgtgggctctgttcttggcgctcgcgaggtgcgcagctctattgctgcgattgaagcgctcggcggcaaggccatctactcgtcgtgcgacgtgaactctgccgccgacgtggccaaggccgtgcgcgatgccgagtcccagctcggtgcccgcgtctcgggcatcgttcatgcctcgggcgtgctccgcgaccgtctcatcgagaagaagctccccgacgagttcgacgccgtctttggcaccaaggtcaccggtctcgagaacctcctcgccgccgtcgaccgcgccaacctcaagcacatggtcctcttcagctcgctcgccggcttccacggcaacgtcggccagtctgactacgccatggccaacgaggcccttaacaagatgggcctcgagctcgccaaggacgtctcggtcaagtcgatctgcttcggtccctgggacggtggcatggtgacgccgcagctcaagaagcagttccaggagatgggcgtgcagatcatcccccgcgagggcggcgctgataccgtggcgcgcatcgtgctcggctcctcgccggctgagatccttgtcggcaactggcgcaccccgtccaagaaggtcggctcggacaccatcaccctgcaccgcaagatttccgccaagtccaaccccttcctcgaggaccacgtcatccagggccgccgcgtgctgcccatgacgctggccattggctcgctcgcggagacctgcctcggcctcttccccggctactcgctctgggccattgacgacgcccagctcttcaagggtgtcactgtcgacggcgacgtcaactgcgaggtgaccctcaccccgtcgacggcgccctcgggccgcgtcaacgtccaggccacgctcaagaccttttccagcggcaagctggtcccggcctaccgcgccgtcatcgtgctctccaaccagggcgcgcccccggccaacgccaccatgcagccgccctcgctcgatgccgatccggcgctccagggctccgtctacgacggcaagaccctcttccacggcccggccttccgcggcatcgatgacgtgctctcgtgcaccaagagccagcttgtggccaagtgcagcgctgtccccggctccgacgccgctcgcggcgagtttgccacggacactgacgcccatgaccccttcgtgaacgacctggcctttcaggccatgctcgtctgggtgcgccgcacgctcggccaggctgcgctccccaactcgatccagcgcatcgtccagcaccgcccggtcccgcaggacaagcccttctacattaccctccgctccaaccagtcgggcggtcactcccagcacaagcacgcccttcagttccacaacgagcagggcgatctcttcattgatgtccaggcttcggtcatcgccacggacagccttgccttc

SEQ ID NO: 18 - protein, 711 aa, Schizochytrium sp.
FGALGGFISQQAERFEPAEILGFTLMCAKFAKASLCTAVAGGRPAFIGVARLDGRLGFTSQGTSDALKRAQRGAIFGLCKTIGLEWSESDVFSRGVDIAQGMHPEDAAVAIVREMACADIRIREVGIGANQQRCTIRAAKLETGNPQRQIAKDDVLLVSGGARGITPLCIREITRQIAGGKYILLGRSKVSASEPAWCAGITDEKAVQKAATQELKRAFSAGEGPKPTPRAVTKLVGSVLGAREVRSSIAAIEALGGKAIYSSCDVNSAADVAKAVRDAESQLGARVSGIVHASGVLRDRLIEKKLPDEFDAVFGTKVTGLENLLAAVDRANLKHMVLFSSLAGFHGNVGQSDYAMANEALNKMGLELAKDVSVKSICFGPWDGGMVTPQLKKQFQEMGVQIIPREGGADTVARIVLGSSPAEILVGNWRTPSKKVGSDTITLHRKISAKSNPFLEDHVIQGRRVLPMTLAIGSLAETCLGLFPGYSLWAIDDAQLFKGVTVDGDVNCEVTLTPSTAPSGRVNVQATLKTFSSGKLVPAYRAVIVLSNQGAPPANATMQPPSLDADPALQGSVYDGKTLFHGPAFRGIDDVLSCTKSQLVAKCSAVPGSDAARGEFATDTDAHDPFVNDLAFQAMLVWVRRTLGQAALPNSIQRIVQHRPVPQDKPFYITLRSNQSGGHSQHKHALQFHNEQGDLFIDVQASVIATDSLAF

SEQ ID NO: 19 - DNA, 1350 bp, Schizochytrium sp.
  CDS (1)..(1350)
atggccgctcggaatgtgagcgccgcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgc

SEQ ID NO: 20 - protein, 450 aa, Schizochytrium sp.
MAARNVSAAHEMHDEKRIAVVGMAVQYAGCKTKDEFWEVLMNGKVESKVISDKRLGSNYRAEHYKAERSKYADTFCNETYGTLDENEIDNEHELLLNLAKQALAETSVKDSTRCGIVSGCLSFPMDNLQGELLNVYQNHVEKKLGARVFKDASHWSEREQSNKPEAGDRRIFMDPASFVAEELNLGALHYSVDAACATALYVLRLAQDHLVSGAADVMLCGATCLPEPFFILSGFSTFQAMPVGTGQNVSMPLHKDSQGLTPGEGGSIMVLKRLDDAIRDGDHIYGTLLGANVSNSGTGLPLKPLLPSEKKCLMDTYTRINVHPHKIQYVECHATGTPQGDRVEIDAVKACFEGKVPRFGTTKGNFGHTLVAAGFAGMCKVLLSMKHGIIPPTPGIDDETKMDPLVVSGEAIPWPETNGEPKRAGLSAFGFGGTNAHAVFEEHDPSNAAC

SEQ ID NO: 21 - DNA, 1323 bp, Schizochytrium sp.
  CDS (1)..(1323)
tcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcg

SEQ ID NO: 22 - protein, 441 aa, Schizochytrium sp.
SARCGGESNMRIAITGMDATFGALKGLDAFERAIYTGAHGAIPLPEKRWRFLGKDKDFLDLCGVKATPHGCYIEDVEVDFQRLRTPMTPEDMLLPQQLLAVTTIDRAILDSGMKKGGNVAVFVGLGTDLELYRHRARVALKERVRPEASKKLNDMMQYINDCGTSTSYTSYIGNLVATRVSSQWGFTGPSFTITEGNNSVYRCAELGKYLLETGEVDGVVVAGVDLCGSAENLYVKSRRFKVSTSDTPRASFDAAADGYFVGEGCGAFVLKRETSCTKDDRIYACMDAIVPGNVPSACLREALDQARVKPGDIEMLELSADSARHLKDPSVLPKELTAEEEIGGLQTILRDDDKLPRNVATGSVKATVGDTGYASGAASLIKAALCIYNRYLPSNGDDWDEPAPEAPWDSTLFACQTSRAWLKNPGERRYAAVSGVSETRS

SEQ ID NO: 23 - DNA, 1500 bp, Schizochytrium sp.
  CDS (1)..(1500)
tgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtc

SEQ ID NO: 24 - protein, 500 aa, Schizochytrium sp.
CYSVLLSEAEGHYERENRISLDEEAPKLIVLRADSHEEILGRLDKIRERFLQPTGAAPRESELKAQARRIFLELLGETLAQDAASSGSQKPLALSLVSTPSKLQREVELAAKGIPRCLKMRRDWSSPAGSRYAPEPLASDRVAFMYGEGRSPYYGITQDIHRIWPELHEVINEKTNRLWAEGDRWVMPRASFKSELESQQQEFDRNMIEMFRLGILTSIAFTNLARDVLNITPKAAFGLSLGEISMIFAFSKKNGLISDQLTKDLRESDVWNKALAVEFNALREAWGIPQSVPKDEFWQGYIVRGTKQDIEAAIAPDSKYVRLTIINDANTALISGKPDACKAAIARLGGNIPALPVTQGMCGHCPEVGPYTKDIAKIHANLEFPVVDGLDLWTTINQKRLVPRATGAKDEWAPSSFGEYAGQLYEKQANFPQIVETIYKQNYDVFVEVGPNNHRSTAVRTTLGPQRNHLAGAIDKQNEDAWTTIVKLVASLKAHLVPGV

SEQ ID NO: 25 - DNA, 1530 bp, Schizochytrium sp.
  CDS (1)..(1530)
ctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctg

SEQ ID NO: 26 - protein, 510 aa, Schizochytrium sp.
LLDLDSMLALSSASASGNLVETAPSDASVIVPPCNIADLGSRAFMKTYGVSAPLYTGAMAKGIASADLVIAAGRQGILASFGAGGLPMQVVRESIEKIQAALPNGPYAVNLIHSPFDSNLEKGNVDLFLEKGVTFVEASAFMTLTPQVVRYRAAGLTRNADGSVNIRNRIIGKVSRTELAEMFMRPAPEHLLQKLIASGEINQEQAELARRVPVADDIAVEADSGGHTDNRPIHVILPLIINLRDRLHRECGYPANLRVRVGAGGGIGCPQAALATFNMGASFIVTGTVNQVAKQSGTCDNVRKQLAKATYSDVCMAPAADMFEEGVKLQVLKKGTMFPSRANKLYELFCKYDSFESMPPAELARVEKRIFSRALEEVWDETKNFYINRLHNPEKIQRAERDPKLKMSLCFRWYLSLASRWANTGASDRVMDYQVWCGPAIGSFNDFIKGTYLDPAVANEYPCVVQINKQILRGACFLRRLEILRNARLSDGAAALVASIDDTYVPAEKL

SEQ ID NO: 27 - DNA, 1350 bp, Schizochytrium sp.
  CDS (1)..(1350)
atggcgctccgtgtcaagacgaacaagaagccatgctgggagatgaccaaggaggagctgaccagcggcaagaccgaggtgttcaactatgaggaactcctcgagttcgcagagggcgacatcgccaaggtcttcggacccgagttcgccgtcatcgacaagtacccgcgccgcgtgcgcctgcccgcccgcgagtacctgctcgtgacccgcgtcaccctcatggacgccgaggtcaacaactaccgcgtcggcgcccgcatggtcaccgagtacgatctccccgtcaacggagagctctccgagggcggagactgcccctgggccgtcctggtcgagagtggccagtgcgatctcatgctcatctcctacatgggcattgacttccagaaccagggcgaccgcgtctaccgcctgctcaacaccacgctcaccttttacggcgtggcccacgagggcgagaccctcgagtacgacattcgcgtcaccggcttcgccaagcgtctcgacggcggcatctccatgttcttcttcgagtacgactgctacgtcaacggccgcctcctcatcgagatgcgcgatggctgcgccggcttcttcaccaacgaggagctcgacgccggcaagggcgtcgtcttcacccgcggcgacctcgccgcccgcgccaagatcccaaagcaggacgtctccccctacgccgtcgccccctgcctccacaagaccaagctcaacgaaaaggagatgcagaccctcgtcgacaaggactgggcatccgtctttggctccaagaacggcatgccggaaatcaactacaaactctgcgcgcgtaagatgctcatgattgaccgcgtcaccagcattgaccacaagggcggtgtctacggcctcggtcagctcgtcggtgaaaagatcctcgagcgcgaccactggtactttccctgccactttgtcaaggatcaggtcatggccggatccctcgtctccgacggctgcagccagatgctcaagatgtacatgatctggctcggcctccacctcaccaccggaccctttgacttccgcccggtcaacggccaccccaacaaggtccgctgccgcggccaaatctccccgcacaagggcaagctcgtctacgtcatggagatcaaggagatgggcttcgacgaggacaacgacccgtacgccattgccgacgtcaacatcattgatgtcgacttcgaaaagggccaggactttagcctcgaccgcatcagcgactacggcaagggcgacctcaacaagaagatcgtcgtcgactttaagggcatcgctctcaagatgcagaagcgctccaccaacaagaacccctcc

SEQ ID NO: 28 - protein, 450 aa, Schizochytrium sp.
MALRVKTNKKPCWEMTKEELTSGKTEVFNYEELLEFAEGDIAKVFGPEFAVIDKYPRRVRLPAREYLLVTRVTLMDAEVNNYRVGARMVTEYDLPVNGELSEGGDCPWAVLVESGQCDLMLISYMGIDFQNQGDRVYRLLNTTLTFYGVAHEGETLEYDIRVTGFAKRLDGGISMFFFEYDCYVNGRLLIEMRDGCAGFFTNEELDAGKGVVFTRGDLAARAKIPKQDVSPYAVAPCLHKTKLNEKEMQTLVDKDWASVFGSKNGMPEINYKLCARKMLMIDRVTSIDHKGGVYGLGQLVGEKILERDHWYFPCHFVKDQVMAGSLVSDGCSQMLKMYMIWLGLHLTTGPFDFRPVNGHPNKVRCRGQISPHKGKLVYVMEIKEMGFDEDNDPYAIADVNIIDVDFEKGQDFSLDRISDYGKGDLNKKIVVDFKGIALKMQKRSTNKNPS

SEQ ID NO: 29 - DNA, 1497 bp, Schizochytrium sp.
  CDS (1)..(1497)
aaggttcagcccgtctttgccaacggcgccgccactgtcggccccgaggcctccaaggcttcctccggcgccagcgccagcgccagcgccgccccggccaagcctgccttcagcgccgatgttcttgcgcccaagcccgttgcccttcccgagcacatcctcaagggcgacgccctcgcccccaaggagatgtcctggcaccccatggcccgcatcccgggcaacccgacgccctcttttgcgccctcggcctacaagccgcgcaacatcgcctttacgcccttccccggcaaccccaacgataacgaccacaccccgggcaagatgccgctcacctggttcaacatggccgagttcatggccggcaaggtcagcatgtgcctcggccccgagttcgccaagttcgacgactcgaacaccagccgcagccccgcttgggacctcgctctcgtcacccgcgccgtgtctgtgtctgacctcaagcacgtcaactaccgcaacatcgacctcgacccctccaagggtaccatggtcggcgagttcgactgccccgcggacgcctggttctacaagggcgcctgcaacgatgcccacatgccgtactcgatcctcatggagatcgccctccagacctcgggtgtgctcacctcggtgctcaaggcgcccctgaccatggagaaggacgacatcctcttccgcaacctcgacgccaacgccgagttcgtgcgcgccgacctcgactaccgcggcaagactatccgcaacgtcaccaagtgcactggctacagcatgctcggcgagatgggcgtccaccgcttcacctttgagctctacgtcgatgatgtgctcttttacaagggctcgacctcgttcggctggttcgtgcccgaggtctttgccgcccaggccggcctcgacaacggccgcaagtcggagccctggttcattgagaacaaggttccggcctcgcaggtctcctcctttgacgtgcgccccaacggcagcggccgcaccgccatcttcgccaacgcccccagcggcgcccagctcaaccgccgcacggaccagggccagtacctcgacgccgtcgacattgtctccggcagcggcaagaagagcctcggctacgcccacggttccaagacggtcaacccgaacgactggttcttctcgtgccacttttggtttgactcggtcatgcccggaagtctcggtgtcgagtccatgttccagctcgtcgaggccatcgccgcccacgaggatctcgctggcaagcacggcattgccaaccccacctttgtgcacgccccgggcaagatcagctggaagtaccgcggccagctcacgcccaagagcaagaagatggactcggaggtccacatcgtgtccgtggacgcccacgacggcgttgtcgacctcgtcgccgacggcttcctctgggccgacagcctccgcgtctactcggtgagcaacattcgcgtgcgcatcgcctccggt

SEQ ID NO: 30 - protein, 499 aa, Schizochytrium sp.
KVQPVFANGAATVGPEASKASSGASASASAAPAKPAFSADVLAPKPVALPEHILKGDALAPKEMSWHPMARIPGNPTPSFAPSAYKPRNIAFTPFPGNPNDNDHTPGKMPLTWFNMAEFMAGKVSMCLGPEFAKFDDSNTSRSPAWDLALVTRAVSVSDLKHVNYRNIDLDPSKGTMVGEFDCPADAWFYKGACNDAHMPYSILMEIALQTSGVLTSVLKAPLTMEKDDILFRNLDANAEFVRADLDYRGKTIRNVTKCTGYSMLGEMGVHRFTFELYVDDVLFYKGSTSFGWFVPEVFAAQAGLDNGRKSEPWFIENKVPASQVSSFDVRPNGSGRTAIFANAPSGAQLNRRTDQGQYLDAVDIVSGSGKKSLGYAHGSKTVNPNDWFFSCHFWFDSVMPGSLGVESMFQLVEAIAAHEDLAGKHGIANPTFVHAPGKISWKYRGQLTPKSKKMDSEVHIVSVDAHDGVVDLVADGFLWADSLRVYSVSNIRVRIASG

SEQ ID NO: 31 - DNA, 1512 bp, Schizochytrium sp.
  CDS (1)..(1512)
gccccgctctacctctcgcaggacccgaccagcggccagctcaagaagcacaccgacgtggcctccggccaggccaccatcgtgcagccctgcacgctcggcgacctcggtgaccgctccttcatggagacctacggcgtcgtcgccccgctgtacacgggcgccatggccaagggcattgcctcggcggacctcgtcatcgccgccggcaagcgcaagatcctcggctcctttggcgccggcggcctccccatgcaccacgtgcgcgccgccctcgagaagatccaggccgccctgcctcagggcccctacgccgtcaacctcatccactcgccttttgacagcaacctcgagaagggcaacgtcgatctcttcctcgagaagggcgtcactgtggtggaggcctcggcattcatgaccctcaccccgcaggtcgtgcgctaccgcgccgccggcctctcgcgcaacgccgacggttcggtcaacatccgcaaccgcatcatcggcaaggtctcgcgcaccgagctcgccgagatgttcatccgcccggccccggagcacctcctcgagaagctcatcgcctcgggcgagatcacccaggagcaggccgagctcgcgcgccgcgttcccgtcgccgacgatatcgctgtcgaggctgactcgggcggccacaccgacaaccgccccatccacgtcatcctcccgctcatcatcaacctccgcaaccgcctgcaccgcgagtgcggctaccccgcgcacctccgcgtccgcgttggcgccggcggtggcgtcggctgcccgcaggccgccgccgccgcgctcaccatgggcgccgccttcatcgtcaccggcactgtcaaccaggtcgccaagcagtccggcacctgcgacaacgtgcgcaagcagctctcgcaggccacctactcggatatctgcatggccccggccgccgacatgttcgaggagggcgtcaagctccaggtcctcaagaagggaaccatgttcccctcgcgcgccaacaagctctacgagctcttttgcaagtacgactccttcgactccatgcctcctgccgagctcgagcgcatcgagaagcgtatcttcaagcgcgcactccaggaggtctgggaggagaccaaggacttttacattaacggtctcaagaacccggagaagatccagcgcgccgagcacgaccccaagctcaagatgtcgctctgcttccgctggtaccttggtcttgccagccgctgggccaacatgggcgccccggaccgcgtcatggactaccaggtctggtgtggcccggccattggcgccttcaacgacttcatcaagggcacctacctcgaccccgctgtctccaacgagtacccctgtgtcgtccagatcaacctgcaaatcctccgtggtgcctgctacctgcgccgtctcaacgccctgcgcaacgacccgcgcattgacctcgagaccgaggatgctgcctttgtctacgagcccaccaacgcgctc

SEQ ID NO: 32 - protein, 504 aa, Schizochytrium sp.
APLYLSQDPTSGQLKKHTDVASGQATIVQPCTLGDLGDRSFMETYGVVAPLYTGAMAKGIASADLVIAAGKRKILGSFGAGGLPMHHVRAALEKIQAALPQGPYAVNLIHSPFDSNLEKGNVDLFLEKGVTVVEASAFMTLTPQVVRYRAAGLSRNADGSVNIRNRIIGKVSRTELAEMFIRPAPEHLLEKLIASGEITQEQAELARRVPVADDIAVEADSGGHTDNRPIHVILPLIINLRNRLHRECGYPAHLRVRVGAGGGVGCPQAAAAALTMGAAFIVTGTVNQVAKQSGTCDNVRKQLSQATYSDICMAPAADMFEEGVKLQVLKKGTMFPSRANKLYELFCKYDSFDSMPPAELERIEKRIFKRALQEVWEETKDFYINGLKNPEKIQRAEHDPKLKMSLCFRWYLGLASRWANMGAPDRVMDYQVWCGPAIGAFNDFIKGTYLDPAVSNEYPCVVQINLQILRGACYLRRLNALRNDPRIDLETEDAAFVYEPTNAL

SEQ ID NO: 33 - DNA, 714 bp, Nostoc sp.
atgttgcagcatacttggctaccaaaacccccaaatttaaccttattgtcagatgaagttcatctctggcgcattccccttgaccaaccagaatcacagctacaggatttagccgctaccttatctagtgacgaattagcccgtgcaaacagattttattttcccgaacatcgccggcgttttactgctggtcgtggtattctccgcagtatcttggggggctatttgggtgtggaaccagggcaagttaaatttgattatgaatcccgtggtaaaccaatattaggcgatcgctttgccgagagtggtttattatttaacttgtcacactcccagaacttggccttgtgtgcagtcaattacacgcgccaaatcggcatcgatttagaatatctccgccccacatctgatttagaatcccttgccaaaaggttctttttaccgcgagaatatgaattattgcgatcgctacccgatgagcaaaaacaaaaaattttctttcgttactggacttgtaaagaggcttatcttaaagcaacgggtgacggcatcgctaaattagaggaaattgaaatagcactaactcccacagaaccagctaagttacagacagctccagcgtggagtctcctagagctagtgccagatgataattgtgttgctgctgttgccgtggcgggttttggctggcagccaaaattctggcattattga

SEQ ID NO: 34 - protein, 237 aa, Nostoc sp.
MLQHTWLPKPPNLTLLSDEVHLWRIPLDQPESQLQDLAATLSSDELARANRFYFPEHRRRFTAGRGILRSILGGYLGVEPGQVKFDYESRGKPILGDRFAESGLLFNLSHSQNLALCAVNYTRQIGIDLEYLRPTSDLESLAKRFFLPREYELLRSLPDEQKQKIFFRYWTCKEAYLKATGDGIAKLEEIEIALTPTEPAKLQTAPAWSLLELVPDDNCVAAVAVAGFGWQPKFWHY

SEQ ID NO: 35 - DNA, 8733 bp, Artificial
  synthetic
atggctgctaggttgcaagaacaaaaaggtggtgagatggatactagaattgctatcattggaatgtctgctattttgccatgtggtactactgttagagaatcttgggaaactattagagctggtattgattgtttgtctgatttgcctgaagatagagttgatgttactgcttactttgatccagttaaaactactaaagataaaatctattgtaagagaggtggtttcattccagaatatgattttgatgctagagaatttggtttgaatatgtttcagatggaagattctgatgctaatcaaactatttctttgttgaaagttaaagaagcattgcaagatgctggcatcgatgctttgggtaaagagaagaagaatattggttgtgttttgggtattggtggtggtcaaaaatcttctcatgaattttactcaagattgaattatgttgttgttgagaaggtattgagaaaaatgggtatgccagaagaagatgttaaagttgctgttgaaaaatacaaagctaattttccagagtggagattggattcttttccaggtttcttgggaaatgttactgcaggaagatgtactaatacttttaatcttgatggcatgaattgtgttgttgatgctgcttgtgcttcttctttgattgctgttaaagttgctattgatgaattgttgtacggtgattgtgatatgatggttactggtgctacttgtactgataattctattggaatgtacatggctttttctaaaactccagttttctctactgatccatctgttagagcttatgatgaaaaaactaaaggaatgttgattggtgaaggttctgctatgttggttttgaaaagatatgctgatgctgttagagatggtgatgaaattcatgctgttattagaggttgtgcttcttcttctgatggtaaagctgctggtatctatactccaactatttctggtcaagaagaagcattgagaagagcttataatagagcttgtgttgatccagctactgttactttggttgaaggtcatggtactggtactccagttggtgatagaattgaattgactgctttgagaaatttgtttgataaagcatatggtgaaggtaatactgaaaaagttgctgttggttctattaaatcttctattggtcatttgaaagctgttgctggtttggctggaatgattaaagttatcatggctttgaaacataaaactttgccaggaactattaatgttgataatccaccaaacttgtacgataatactccaattaacgaatcttctttgtacattaatactatgaatagaccttggtttccaccaccaggtgttccaagaagagctggtatttcttcttttggttttggtggtgctaattatcatgctgttttggaagaagctgaaccagaacatactactgcttataggttgaacaaaagaccacaaccagttttgatgatggctgctactccagctgctttgcaatctttgtgtgaagctcaattgaaagaatttgaagctgctattaaagaaaacgaaactgttaaaaatactgcttatattaaatgtgttaaatttggtgaacaattcaaattccctggtagtattccagctactaatgctaggttgggtttcttggttaaagatgctgaagatgcttgttctactttgagagctatttgtgctcaatttgctaaagatgttactaaagaagcatggagattgccaagagaaggtgtttcttttagagctaaaggtattgctactaatggtgctgttgctgctttgttttctggtcaaggtgctcaatatactcatatgttttctgaagttgctatgaattggccacaattcagacaatctattgctgctatggatgctgctcaatctaaagttgctggttctgataaagattttgaaagagtttctcaagttttgtatccaagaaaaccatacgagagagaaccagagcaagatcataagaagatttctttgactgcttattctcaaccatctactttggcttgtgctttgggtgcttttgaaatttttaaagaagctggttttactccagattttgctgctggtcattctttgggtgaatttgctgctttgtacgctgctggttgtgttgatagagatgaattgtttgaattggtttgtagaagagctagaattatgggtggtaaagatgctccagctactccaaaaggttgcatggctgctgttattggtccaaatgctgaaaatattaaagttcaagctgctaatgtttggttaggaaattctaattctccatctcaaactgttattactggttctgttgaaggtattcaagctgaatctgctaggttgcaaaaagaaggttttagagttgttccattggcttgtgaatctgcttttcattctccacagatggaaaatgcttcttctgcttttaaagatgttatctctaaagtttcttttagaactccaaaagctgaaactaaattgttttctaatgtttctggtgaaacttatccaactgatgctagagaaatgttgactcaacatatgacttcttctgttaaatttttgactcaagttagaaatatgcatcaagctggtgctagaatttttgttgaattcggtccaaaacaagttttgtctaaattggtttctgaaactttgaaagatgatccatctgttgttactgtttctgttaatccagcttctggtactgattctgatattcaattgagagatgctgctgttcaattggttgttgctggtgttaatttgcaaggttttgataaatgggatgctccagatgctactagaatgcaagctattaaaaaaaaaagaactactttgagattgtctgctgctacttatgtttctgataaaactaagaaagttagagatgctgctatgaatgatggtagatgtgttacttacttgaaaggtgctgctccattgattaaagctccagaaccagttgttgatgaagctgctaaaagagaagctgaaagattgcaaaaagaattgcaagatgctcaaagacaattggatgatgctaaaagagctgctgctgaagctaattctaaattggctgctgctaaagaagaagctaaaactgctgctgcttctgctaaaccagctgttgatactgctgttgttgaaaaacatagagctattttgaaatctatgttggctgaattggatggttatggttctgttgatgcttcttctttgcaacaacaacaacaacaacaaactgctccagctccagttaaagctgctgctccagctgctccagttgcttctgctccagcacccgcagttagcaacgaactcttagaaaaagccgagacagtagtgatggaagttcttgcagctaaaacggggtacgaaacagatatgattgaagcagatatggaacttgaaactgaactgggcattgattcgattaaacgcgtggaaattctgtcagaagtgcaagctatgttaaatgttgaagcgaaagatgttgatgcactgtcacgcacacgcaccgtgggcgaagtagtgaacgccatgaaagcagaaattgcaggctcctcagcacccgcgccggccgcagcagcaccagcccccgcaaaagccgcccccgcagcggcggctccagccgtttcaaacgaattactcgaaaaagcagaaaccgtagtgatggaagtccttgccgccaaaacgggttatgagaccgatatgatcgaaagcgatatggaattagaaaccgaattagggattgatagtattaaacgcgtagaaattctgtccgaagtacaagctatgctgaatgtagaagcaaaagatgtagatgcgttaagccgcacacgcactgttggtgaagttgtgaatgctatgaaagctgaaattgcaggaggttcagcaccggccccagcagccgcagccccaggtccagcagcagccgcaccggcccccgccgccgccgcaccggcagtatcaaacgagttgttagagaaagcggaaaccgttgtgatggaagtacttgccgcgaagacaggttacgagaccgatatgatcgaaagtgacatggaattagaaaccgaattgggcattgatagcattaaacgcgtagaaattttatccgaagttcaagccatgttaaatgttgaagccaaagatgtggatgcgttatcccgcacgcgtaccgtcggagaagtagtggacgctatgaaagcagagattgcaggaggaagtgcaccggctccagcagcagcagcacccgccccagcggcagcggcgccggcaccggccgctccggccccagccgttagttcagaactcctcgaaaaagcagaaactgttgtcatggaagtattagctgcaaaaacaggttacgagacggatatgattgaaagcgatatggaattagaaaccgaattaggcattgattcaattaaacgtgttgaaatcttaagtgaagtccaagccatgcttaatgttgaagccaaagatgtagatgcattatctcgcacgcgtacagtgggtgaagttgtcgatgcgatgaaagcagaaatcgcgggaggatcagcgccagccccggcagcagcagcccccgcgcccgccgcggccgcacctgcgccggccgccccagcccctgcagcaccggccccagcagtgtcgtcggaattactcgaaaaagctgaaacggtcgttatggaagtacttgctgcaaagacgggctatgaaacggatatgattgaatcggatatggaattagaaacagaacttggtattgactctattaaacgcgtggaaattctgagcgaagtacaggcaatgttaaacgtagaagccaaagatgtagacgctttgtcacgcacacggacggtaggagaagttgtggatgcgatgaaagctgaaattgccggttcaagtgctagcgcccctgctgccgccgcccctgcccctgccgccgcagcaccggccccggcagccgcagctccagcagttagtaacgaattactcgaaaaagcagaaacggtggtcatggaagtgttagcagcaaaaactggatatgaaacggacatgattgaaagcgatatggaattagaaacagaactgggaattgatagtattaaacgtgttgagattttatctgaggttcaagctatgctgaatgttgaagcgaaagatgtagacgcactgtctcggacccgcacagtaggtgaagtggtggacgcgatgaaagcagaaatcgcaggtggaagtgctccggccccggcggcagccgcacccgcgcccgcggccgcagccccagcagttagcaacgaattactcgagaaagcagaaactgtagtgatggaagtgttagccgcaaaaacgggttatgaaacggatatgattgaaagcgatatggaactggaaaccgaactgggcattgattctattaaacgtgtcgaaatcttatcggaagtccaagcaatgctgaacgtagaggcaaaggatgttgatgccctgtcacgtacccgtaccgtaggtgaagttgtagatgccatgaaagctgaaatcgcaggcagtagcgccccggcaccagccgccgccgcccccgcgccggcagccgccgcacccgcgccagccgcagctgctccagctgtatctagtgagctgctcgaaaaagcagaaaccgtggttatggaagtgctcgccgctaaaacaggatatgaaaccgatatgattgaaagcgatatggaattagaaaccgaactgggtattgatagtattaagcgtgttgaaattttgtcagaagttcaagctatgttgaatgtagaagccaaagatgtagacgctttaagtcggacgcgtactgttggagaagtcgtagacgccatgaaagcagagattgcaggcggaagtgcaccggccccggcagcagcagccccagcaccagcggccgccgctcctgcagtgtcaaacgaacttctggaaaaagctgaaaccgtcgtcatggaagtgctggctgcaaaaactggatatgaaacagacatgattgaatcagatatggaactcgaaaccgaactggggattgatagcattaaacgtgtggaaattttatcggaggtacaagcaatgttaaatgtggaagcaaaagatgtggatgcactgagccgtactcgtactgttggtgaggtcgtggatgcgatgaaagcagaaattgctggagggagtgcgcctgccccggccgccgccgcacccgcgtctgccggtgctgcccccgctgtcaaaattgattctgttcatggtgctgattgtgatgatttgtctttgatgcatgctaaagttgttgatattagaagaccagatgaattgattttggaaagaccagaaaatagaccagttttggttgttgatgatggttctgaattgactttggctttggttagagttttgggtgcttgtgctgttgttttgacttttgaaggtttgcaattggctcaaagagctggtgctgctgctattagacatgttttggctaaagatttgtctgctgaatctgctgaaaaagctattaaagaagctgaacaaagatttggtgctttgggtggttttatctctcaacaagctgaaagatttgaaccagctgaaattttgggttttactttgatgtgtgctaaatttgctaaagcatctttgtgcactgctgttgctggtggtagaccagctttcattggtgttgctaggttggatggtaggttgggttttacttctcaaggaacttctgatgctttgaaaagagctcaaagaggtgctatttttggtttgtgcaagactattggtttggaatggtctgaatctgatgttttctcaagaggtgttgatattgctcaaggtatgcatccagaagatgctgctgttgctattgttagagaaatggcttgtgctgatattagaattagagaagttggtattggtgctaatcaacaaagatgtactattagagctgctaaattggaaactggaaatccacaaagacaaattgctaaagatgatgttttgttggtttctggtggtgctagaggaattactccattgtgcattagagaaattactagacaaattgctggtggaaagtatattttgttgggtaggtctaaagtttctgcttctgaaccagcttggtgtgctggtattactgatgaaaaagctgttcaaaaagctgctactcaagaattgaaaagagctttttctgctggtgaaggtccaaaaccaactccaagagctgttactaaattggttggttctgttttgggtgctagagaagttaggtcttctattgctgctattgaagcattgggtggaaaagctatctattcttcttgtgatgttaattctgctgctgatgttgctaaagctgttagagatgctgaatctcaattgggtgctagagtttctggtattgttcatgcttctggtgttttgagagataggttgattgaaaaaaaattgccagatgaatttgatgctgtttttggtactaaagttactggtttggaaaatttgttggctgctgttgatagagctaatttgaaacatatggttttgttttcttctttggctggttttcatggtaatgttggtcaatctgattatgctatggctaacgaagcattgaacaaaatgggtttggaattggctaaagatgtttctgttaaatctatttgttttggtccttgggatggtggtatggttactccacaattgaaaaaacaatttcaagaaatgggtgttcaaattattccaagagaaggtggtgctgatactgttgctagaattgttttgggttcttctccagctgaaattttggttggtaattggagaactccatctaaaaaagttggttctgatactattactttgcacagaaaaatttctgctaaatctaatccatttttggaagatcatgtcattcaaggtagaagagttttgccaatgactttggctattggttctttggctgaaacttgtttgggtttgtttcctggatattctttgtgggctattgatgatgctcaattgtttaaaggtgttactgttgatggtgatgttaattgtgaagttactttgactccatctactgctccttctggtagagttaatgttcaagctactttgaaaactttttcttctggtaaattggttccagcttatagagctgttattgttttgtctaatcaaggtgctccaccagctaatgctactatgcaaccaccatctttggatgctgatccagctttgcaaggttctgtttatgatggaaagactttgtttcatggtccagcttttagaggtattgatgatgttttgtcttgtactaaatctcaattggttgctaaatgttctgctgttccaggttctgatgctgctagaggtgaatttgctactgatactgatgctcatgatccatttgttaatgatttggcttttcaagctatgttggtttgggttagaagaactttgggtcaagctgctttgccaaattctattcaaagaattgttcaacacagaccagttccacaagataaaccattttatattactttgagatctaatcaatctggtggtcattctcaacataaacatgctttgcaatttcataacgaacaaggtgatttgttcattgatgttcaagcatctgttattgctactgattctttggctttttaa

SEQ ID NO: 36 - DNA, 6180 bp, Artificial
  synthetic
atggctgctagaaatgtttctgctgctcatgaaatgcatgatgaaaaaagaattgctgttgttggtatggctgttcaatatgctggttgtaagactaaagatgaattttgggaagttttgatgaatggtaaagttgaatctaaagttatctctgataaaagattgggttctaattaccgagctgaacattacaaggctgaaagatccaaatacgctgatactttttgtaacgaaacttatggtactttggatgaaaacgaaattgataacgaacatgaattgttgttgaatttggctaaacaagcattggctgaaacttctgttaaagattctactagatgtggtattgtttctggttgtttgtcttttcctatggataatttgcaaggtgaattgttgaatgtctatcaaaatcatgttgagaagaaattgggtgctagagtttttaaagatgcttctcattggtctgaaagagaacaatctaacaaaccagaagctggtgatagaagaattttcatggacccagcttcttttgttgctgaagaattgaatttgggtgctttgcattattctgttgatgctgcttgtgctactgctttatacgttttgagattggctcaagatcatttggtttctggtgctgctgatgttatgttgtgtggtgctacttgtttgccagaaccattctttatcttgtctggtttttctacttttcaagctatgccagttggtactggtcaaaatgtttctatgccattgcataaagattctcaaggtttgactccaggtgaaggtggttctatcatggttttgaaaagattggatgatgctattagagatggtgatcatatctatggtactttgttgggtgctaatgtttctaattctggcactggtttgccattgaaaccattgttgccatctgaaaaaaaatgtttgatggatacttatactagaattaatgttcatccacataaaattcaatatgttgaatgtcatgctactggtactccacaaggtgatagggttgaaattgatgctgttaaagcatgttttgaaggaaaagttccaagatttggtactactaaaggaaactttggtcatactttggttgctgctggttttgctggaatgtgcaaagttttgttgtctatgaaacatggtatcattccaccaactccaggtattgatgatgaaactaagatggacccattggttgtttctggtgaagctattccttggccagaaactaatggtgaaccaaaaagagctggtttgtctgcttttggttttggtggtactaatgctcatgctgtttttgaagaacatgatccatctaatgctgcttgtactggtcatgattctatttctgctttgtctgctagatgtggtggtgaatctaatatgagaattgctattactggtatggatgctacttttggtgctttgaaaggtttggatgcttttgaaagagccatctacactggtgctcatggtgctattccattgccagaaaagagatggagatttttgggcaaagataaagatttcttggatttgtgtggtgttaaagctactccacatggttgttatattgaagatgttgaagttgattttcaaagattgagaactccaatgactccagaagatatgttgttgccacaacaattgttggctgttactactattgatagagctattttggattctggtatgaaaaaaggtggtaatgttgctgtttttgttggtttgggtaccgatttggaattgtacagacatagagctagagttgctttgaaagaaagagttagaccagaagcatctaaaaaattgaatgatatgatgcagtacattaatgattgtggcacctctacttcttatacttcttatattggtaatttggttgctactagagtttcttctcaatggggttttactggtccatcttttactattactgaagggaataactctgtttatagatgtgctgaattgggaaagtatttgttggaaactggtgaagttgatggtgttgttgttgctggtgttgatttgtgtggttctgctgaaaacttatacgttaaatcaagaagattcaaagtttctacttctgatactccaagagcttcttttgatgctgctgctgatggttactttgttggtgaaggttgtggtgcttttgttttgaaaagagaaacttcttgtactaaagatgatagaatctatgcttgcatggatgctattgttccaggtaatgttccatctgcttgtttgagagaagcattggatcaagctagagttaaaccaggtgatattgaaatgttggaattgtctgctgattctgctagacatttgaaagatccatctgttttgccaaaagaattgactgctgaagaagaaattggtggtttgcaaactattttgagagatgatgataaattgccaagaaatgttgctactggttctgttaaagctactgttggtgatactggttatgcttctggtgctgcttctttgattaaagctgctttgtgcatctataataggtatttgccatctaatggtgatgattgggatgaaccagctccagaagctccttgggattctactttgtttgcttgtcaaacttcaagagcttggttgaaaaatcctggagagagaagatatgctgctgtttctggtgtttctgaaactaggtcttgttattctgttttgttgtctgaagctgaaggtcattatgaaagagaaaatagaatttctttggatgaagaagctccaaaattgattgttttgagagctgattctcatgaagaaattttgggtaggttggataaaattagagaaagatttttgcaaccaactggtgctgctccaagagaatctgaattgaaagctcaagctagaagaattttcttggaattgttgggtgaaactttggctcaagatgctgcttcttctggttctcaaaaaccattggctttgtctttggtttctactccatctaaattgcaaagagaagttgaattggctgctaaaggtattccaagatgtttgaaaatgagaagagattggtcttctccagctggttcaagatatgctccagaaccattggcttctgatagagttgctttcatgtacggtgaaggaaggtctccatactatggaatcactcaagatattcatagaatttggccagaattgcatgaagttattaacgaaaaaactaataggttgtgggctgaaggtgatagatgggttatgccaagagcttcttttaaatctgaattggaatctcaacaacaagaatttgatagaaatatgattgaaatgtttaggttgggtattttgacttctattgcttttactaatttggctagagatgttttgaatattactccaaaagctgcttttggtttgtctttgggtgaaatttctatgatttttgctttttctaaaaaaaatggtttgatttctgatcaattgactaaagatttgagagaatctgatgtttggaacaaagcattggctgttgaattcaatgctttgagagaagcatggggtattccacaatctgttccaaaagatgaattttggcaaggttatattgttagaggtactaaacaagatattgaagctgctattgctccagattccaaatacgttaggttgactatcattaatgatgctaatactgctttgatttctggtaaaccagatgcttgtaaagctgctattgctaggttgggtggtaatattccagctttgccagttactcaaggaatgtgtggtcattgtccagaagttggtccatatactaaagatattgctaaaattcatgctaatttggaatttccagttgttgatggtttggatttgtggactactattaatcaaaaaagattggttccaagagctactggtgctaaagatgaatgggctccatcttcttttggtgaatatgctggtcaactttacgaaaaacaagctaattttccacaaattgttgaaactatctacaaacaaaattatgatgtttttgttgaggttggtccaaacaaccataggtctactgctgttagaactactttgggtccacaaagaaatcatttggctggtgctattgataaacaaaacgaagatgcttggactactattgttaaattggttgcttctttgaaagctcatttggttccaggtgttactatttctccattgtatcattctaaattggttgctgaagctgaagcatgttatgctgctctgtgcaaaggagaaaaacctaagaagaacaaatttgttagaaaaattcaattgaatggtaggttcaattctaaagctgatccaatttcttctgctgatttggcttcttttccaccagctgatccagctattgaagctgctatttcttcaagaattatgaaaccagttgctccaaaattttatgctaggttgaatattgatgaacaagacgaaacaagagatccaattttgaacaaagataatgctccatctagttcatctagttcctcttcatctagttcttcatctagttctccatctccagctccttctgctccagttcaaaaaaaagctgctccagctgctgaaactaaagctgttgcttctgctgatgctttgagatctgctttgttggatttggattctatgttggctttgtcttctgcttctgcttctggtaatttggttgaaactgctccatctgatgcttctgttattgttccaccatgtaatattgctgatttgggttcaagagcttttatgaaaacttatggtgtttctgctccattgtacactggtgctatggctaaaggtattgcttctgctgatttggttattgctgctggtagacaaggcattttggcttcttttggtgctggtggtttgccaatgcaagttgttagagaatctattgaaaaaattcaagctgctttgccaaatggtccatatgctgttaatttgattcattctccatttgattctaatttggaaaaaggtaatgttgatttgtttttggaaaaaggtgttacttttgttgaagcatctgcttttatgactttgactccacaagttgttaggtacagagctgctggtttgactagaaatgctgatggttctgttaatattagaaatagaattatcggaaaggtttcaagaactgaattggctgaaatgtttatgagacctgccccagaacacttgttgcaaaaattgattgcttctggtgaaattaatcaagaacaagctgaattggctagaagagttccagttgctgatgatattgctgttgaagctgattctggtggtcatactgataatagaccaattcatgttatcttgccattgattattaatttgagagacagattgcatagagaatgtggttatccagctaatttgagagttagagttggtgctggtggtggtattggttgtccacaagctgctttggctacttttaatatgggtgcttctttcattgttactggcactgttaatcaagttgctaaacaatctggtacttgtgataatgttagaaaacaattggctaaagctacttattctgatgtttgcatggctccagctgctgatatgtttgaagaaggtgttaaattgcaagttttgaagaaagggacaatgtttccatcaagagctaataagttatacgaattgttttgcaagtatgattcttttgaatctatgccaccagctgaattggctagagttgaaaaaagaattttctcaagagctttggaagaagtttgggatgaaactaaaaatttttacattaataggttgcacaatccagaaaaaattcaaagagctgaaagagatccaaaattgaaaatgtctttgtgttttagatggtatttgtctttggcttcaagatgggctaatactggtgcttctgatagagttatggattatcaagtttggtgtggtccagctattggttcttttaatgatttcattaaaggcacctacttggacccagctgttgctaacgaatatccatgcgttgttcaaattaacaaacaaattttgagaggtgcttgtttcctcagaagattggaaattttgagaaatgctaggttgtctgatggtgctgctgctttggttgcttctattgatgatacttatgttccagctgaaaaattgtaa

SEQ ID NO: 37 - DNA, 6180 bp, Artificial
  synthetic
atggccgctcgcaacgtgtctgcagcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgcacgggccacgactccatttctgcgctctcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcgtgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtcacgatctcgccgctgtaccactccaagcttgtggcggaggctgaggcttgctacgctgcgctctgcaagggtgaaaagcccaagaagaacaagtttgtgcgcaagattcagctcaacggtcgcttcaacagcaaggcggaccccatctcctcggccgatcttgccagctttccgcctgcggaccctgccattgaagccgccatctcgagccgcatcatgaagccggttgctccgaagttctacgcgcgtctcaacattgacgagcaggacgagacccgtgatccgatcctcaacaaggacaacgcgccgtcttccagctctagctcctcttccagctcttccagctcttccagcccgtcgccagctccgtccgccccagtgcaaaagaaggctgctccggccgcggagaccaaggctgttgcttcggctgacgcacttcgcagtgccctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctgtaa

SEQ ID NO: 38 - DNA, 8436 bp, Thraustochytrium sp.
  CDS (1)..(8433)
atgaaggacatggaagatagacgggtcgctattgtgggcatgtcagctcacttgccttgtgggacagatgtgaaggaatcatggcaggctattcgcgatggaatcgactgtctaagtgacctacccgcggatcgtctcgacgttacagcttactacaatcccaacaaagccacgaaagacaagatctactgcaaacggggtggcttcatcccgaactatgacttcgacccccgcgaatttgggctcaacatgtttcaaatggaagactctgatgcgaatcagacacttaccttgctcaaagtcaaacaagctctcgaagatgcaagcatagagcctttcaccaaggagaagaagaacattggatgtgttttaggtattggtgggggccaaaaggcgagtcatgagttctactctcgtctcaactacgttgtcgttgaaaaggtacttcggaaaatgggtttaccagatgctgatgttgaagaagctgtggagaaatacaaggcaaattttcccgagtggcgcctagactctttccctgggtttcttgggaatgtaacggctggtcggtgcagtaacaccttcaacatggaaggtatgaactgcgttgtggatgctgcatgtgccagttctctaattgcaatcaaggttgcagttgaagagctactctttggtgactgtgacaccatgattgcaggtgccacctgcacggacaattcacttggcatgtacatggccttctctaaaacgccagttttttctactgacccaagtgtccgcgcgtatgatgagaaaacaaaagggatgctaattggagaaggttcagcaatgttcgttcttaaacgctatgcggatgccgtacgtgatggcgacacaattcacgcggttctgcgttcttgctcttcgtctagtgatggaaaagcggcaggaatttatactcctactatatctggacaagaagaagctttgcgtcgagcgtatgcccgtgcgggggtatgtccatctacgatcgggcttgttgagggtcacgggacagggacccctgttggagatcgcattgagttaacagctctgcggaacttgtttgacaaagcttttggtagcaagaaggaacaaatagcagttggcagcataaagtctcagataggtcacctgaaatctgttgccggctttgccggcttggtcaaagctgtgcttgcgcttaaacacaaaacgctcccaggttcgattaatgtcgaccagccacctttgttgtatgacggtactcaaattcaagactcttctttatatatcaacaagacaaatagaccatggtttacgcaaaacaagcttccgcgtcgggctggtgtctcaagttttggatttggaggtgcaaactaccacgcggttctggaagaattcgagcccgagcatgaaaaaccataccgcctcaatactgttggacatcctgtcctcttgtacgctccgtctgtggaagccctcaaagtactttgcaacgaccagcttgcggagctcacaattgcattggaagaggcaaaaacacataaaaatgttgacaaagtttgtggctacaagtttattgacgaatttcagctccaaggaagctgtcctccagaaaatccgagagtaggatttttagcaacactgcctacttcaaatatcattgtcgcgcttaaggcaattctcgcgcagcttgatgcaaaaccagatgcgaagaaatgggatttgcctcataaaaaggcttttggggctaccttcgcatcgtcttcagtgaaaggctctgttgctgcgctcttcgcaggacagggtacccagtacttaaacatgttctctgatgtggcaatgaactggccaccgttccgtgacagcattgtcgcaatggaagaagctcaaactgaggtatttgagggccaagttgaaccaattagcaaagttctgtttccacgagagcgctatgcatccgaaagtgaacaggggaatgaacttctttgcttaacagagtactctcagccaactacgatagcagccgcagtaggggccttcgatattttcaaagcggctggctttaagccagacatggttggagggcattcacttggcgaatttgctgctttgtacgcggctgggtccatttcgcgtgacgacctgtacaagcttgtgtgcaaacgggcaaaggcaatggcgaacgctagtgacggagctatggcagcagtgattggcccagatgcacgtctagttacgccacaaaatagtgacgtttatgtcgcaaacttcaactccgcaactcaagtagtcatcagtggcactgttcaaggtgtgaaagaagagtcgaaattgctcatttcaaaggggttccgcgtactgccacttaaatgccagggcgccttccattctcctttgatggggccttctgaggatagtttcaaatcacttgtggagacttgtaccatctcgccgccaaaaaatgtgaaattcttttgcaatgttagtggcaaggaaagcccaaacccaaaacagaccctcaagtcacacatgacgtctagcgttcagttcgaggagcagattcgtaacatgtacgatgccggagcacgtgtttttctggagtttggaccccgccaagtccttgcaaagcttatcgcggaaatgtttccctcgtgtacagctatcagcgttaaccccgcgagcagtggtgacagtgacgtgcaactccgcctcgccgccgtaaaattcgcggtctcgggtgcagcccttagcacctttgatccatgggagtatcgcaagccacaagatcttcttattcgaaaaccacgaaaaactgcccttgttctatcagcagcaacatatgtttccccaaagactcttgcagaacgtaaaaaggctatggaagatatcaagctagtatccattacaccaagagatagtatggtatcaattggaaaaatcgcgcaagaagtacggacagctaaacagcctttagaaaccgaaattcgaagactcaacaaagaattagaacatctcaagagagagctagcagcagccaaagcgagtgtcaagtctgcatcaaaaagctctaaagagcgatctgtcctatcaaagcaccgcgctttgcttcaaaacattttgcaagactacgatgatcttcgtgtggtgccattcgctgttcgttctgttgcagtggacaacaccgcgccgtatgctgaccaagtttcgaccccagcgtcagagcggtcggcttcaccgcttttcgagaaacgcagttcggtttcgtcagcacgcctcgctgaagctgaagccgcggtactgagcgttctcgcagacaagacaggctacgacagctcaatgatcgagatggacatggacctggagagtgagcttggcgttgatagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgaccgcggaatcgatccgtcagccaccggtgtccgagcctgctgtaccgacctcatcgtcaagcagtattgctaatgtttcgtcagcacgcctcgctgaagctgaagctgcggtactgagcgttctcgcagacaagacaggctacgacagctcaatgatcgagatggacatggacctggagagcgagcttggcgttgatagcatcaaacgcgtggagatcatgagcgaggttcaaacgctgctcagcgtggaagtctccgacgttgacgctctgtcaagaactaagactgttggcgacgtcatcgaggcgatgaagctggaactcggtggaccccaaggccagactttgaccgcggaatcgatccgtcagccaccggtgtctgagcctgctgtaccgacctcatcgtcaagcagtattgctaatgtttcgtcagcacgcctcgctgaagctgaagcggcggtactgagcgttctcgcagacaagacaggctacgacagctcaatgatcgagatggacatggacctggagagcgagcttggcgtcgacagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgaccgcggaatcgatccgtcagccaccggtgtccgagcctgctgtaccgacctcatcgtcaagcagtattgctaatgttttgtcagcacgcctcgctgaagctgaagccgcggtactgagcgttctcgcagacaagacaggctacgacagctcaatgatcgagatggacatggacctggagagcgagcttggcgttgatagcatcaaacgcgtggagatcatgagcgaggttcaaacgttgctcagcgtggaagtctccgacgttgacgctctgtcaagaaccaagactgttggcgacgtcatcgaggcgatgaagctggaactcggtggaccccaaggccagactttgaccgcggaatcgatccgtcagccaccggtgtctgagcctgctgtaccgacctcatcgtcaagcagtattgctaatgtttcgtcagcacgcctcgctgaagctgaagccgcggtactgagcgttctcgcagacaagacaggctacgacagctcaatgatcgagatggacatggacctggagagtgagcttggcgtcgacagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgacctctgaaccgatccatcagccaccagtgtccgagcctgctgtaccgacctcatcgtcaagcagtattgctaatgtttcttcagcacgcctcgctgaagctgaagccgcggtactgagcgttctcgcagacaagacaggctacgacagctcaatgatcgagatggacatggacctggagagcgagcttggcgttgatagcatcaaacgcgtggaaatcatgagcgaggttcaaacgctgctcagcgtggaagtctccgacgttgacgctctgtcaagaaccaagactgttggcgacgtcatcgaggcgatgaagatggaactcggtggaccccaaggccagactttgaccgcggaatcgatccgtcagccaccggtgtctgagcctgctgtaccgacctcatcgtcaagcagtattgctaatgtttcgtcagcacgcctcgctgaagctgaagcggcggtactgagcgttctcgcagacaagacaggctacgacagctcaatgatcgagatggacatggacctggagagcgagcttggcgttgatagcatcaaacgcgtggagatcatgagcgaggttcaagcgctgctcagcgtggaagtctccgacgttgacgctctgtcaagaaccaagactgttggcgacgtcatcgaggcgatgaagatggaactcggtggaccccaaggccagactttgaccgcagaatcgatccgtgagccaccggtgtctgagcctgctgtaccgacctcatcgtcaagtagtatcgctaatgtttcttcagctcgcctcgctgaagctgaagccgcggtactgagcgttctcgcagacaagacaggctacgacagctcaatgatcgagatggacatggacctggagagtgagcttggcgtcgacagcatcaaacgcgtggagatcatgagcgaggttcaaacgttgctcagcgtggaagtctccgacgttgacgctctgtcaagaaccaagactgttggcgacgtcatcgaggcgatgaagctggaacttggggaatcatcaagtattgagactctcaattgtaccgaggttgagcacacgagctacaaaagtgtcaaggcttcagggtgtgagaatgtagatacccgtttcgctaaggttgtacaaatctcgcttcctagcaagctgaaatccactgtgtcgcacgatcgacctgtaattgttgtagatgatggaacgcccttaaccacggagctttgtaaaattcttgggggtaatattgtggttctctcttatcaagggaagcccgctggtccacggggagtcgaggtgccagatctttccgaggaagccctaattcaagctcttgcattgattcggtctacatatggagttccaattggttttatttgtcagcaagtgtctaatgtgagcaccaaggcacagctttgttgggcactcctcgcagcgaagcatctcaagaaggatttgaatgctgtcttacccgattcaagatccttcttcgtcggagttgtacgcttgaacgggaaacttggaactttcgaaaacatcagcgacttctctaaatttgatttgacgaaagccctagattacggacagcgtggttctctcttaggcctgtgcaagtcactagacttagaatgggaacaggtgttttgccgtggaatagatcttgcgtgtgatcttatgccactccaggccgcaaggatactcagaaatgagcttcagtgtcccaatatgcgccttcgcgaggttgggtacgatatttctggcgccaggtacaccatttcaaccgatgacctgctatgtggaccctcgaaggctaaagtagaggccgcagacttgtttcttgtgacaggtggcgcacgaggtattacacctcattgtgttcgtgagattgcaagtcgatcccccggaaccacatttgtgctggttggaagaagcgaaatgtccgacgagcctgactgggctgttggccactacaataaagacctggaccaaagcacaatgaaacacttgaaagcaacgcatgctgctggaggggtaaaacctacgcctaaagcacatcgtgcacttgtgaacagggtcactggctcacgggaggtacgagaatctcttagagcaatccaggaggcaggggcaaatgtcgaatatatcgcctgtgatgtttcggatgaaaacaaggtccgccaacttgtgcaaagagtggagcaaaagtatggctgtgaaataactgggatttggcatgcaagcggggttcttcgtgacaaacttgtcgagcaaaagactacagacgactttgaggcagtttttgggaccaaggtgactggccttgtaaacatcgtgtcacaagtcaatatgtctaagctacgacacttcatcctcttcagttctttggctggatttcatgggaacaagggccaaacggattatgcaattgctaatgaagccttgaacaaaatcgcgcatactctctcagcgtttttgcccaaactgaatgcaaaggtgctagacttcggtccgtgggtaggttcaggaatggtaaccgaaacacttgagaagcattttaaagctatgggggttcagactattcctctcgagccaggagcacggactgttgcgcaaatcattttggcaagttcgccaccgcaatcgcttttggggaactggggctttccagccaccaaaccgctacaacgctctaatgtagtcacgggcacactctctccggaagagatagaattcatcgcagaccacaaaattcaaggccgcaaggtgcttcccatgatggctgcaatcgggttcatggcctctattgcggaaggactctacccggggtacaatctgcaaggcgtggaaaatgctcagctctttcaaggcttgactatcaaccaagagacaaaatttcaaatcactctcattgaggagcacaactctgaggaaaacctggatgtcctgacatcccttggtgtaatgttggaaagcgggaaggtgcttcccgcttaccgatgtgttgtatgcttgaatacaacccagcagcagcccaagctatctccaaaaattcttaacttggaagttgaccctgcatgcgaggttaacccctatgatggaaagtcgttgttccacggtccgcttttgcaattcgttcaacaagtgttgcactcaagtaccaaaggcctcgttgccaagtgccgcgcgcttccaatcaaagaagccatccgagggccatttatcaagcaaacactccatgatccaattctagacgacgtcatttttcagctaatgctcgtgtggtgtcgtaatgctctaggaagtgcatcgctacccaacagaattgaaaagatgtcatactttgggaatgtctcagaaggtagcactttctttgcctcagttacacctgtgggaccaagagtaccaaaggatcccgtgatcaaaatgcagtttcttctccaagatgaatccggcaacacattttcatcgggggagggctcggttgtgcttagtgacgaactcgtcttttga

SEQ ID NO: 39 - protein, 2811 aa, Thraustochytrium sp.
MKDMEDRRVAIVGMSAHLPCGTDVKESWQAIRDGIDCLSDLPADRLDVTAYYNPNKATKDKIYCKRGGFIPNYDFDPREFGLNMFQMEDSDANQTLTLLKVKQALEDASIEPFTKEKKNIGCVLGIGGGQKASHEFYSRLNYVVVEKVLRKMGLPDADVEEAVEKYKANFPEWRLDSFPGFLGNVTAGRCSNTFNMEGMNCVVDAACASSLIAIKVAVEELLFGDCDTMIAGATCTDNSLGMYMAFSKTPVFSTDPSVRAYDEKTKGMLIGEGSAMFVLKRYADAVRDGDTIHAVLRSCSSSSDGKAAGIYTPTISGQEEALRRAYARAGVCPSTIGLVEGHGTGTPVGDRIELTALRNLFDKAFGSKKEQIAVGSIKSQIGHLKSVAGFAGLVKAVLALKHKTLPGSINVDQPPLLYDGTQIQDSSLYINKTNRPWFTQNKLPRRAGVSSFGFGGANYHAVLEEFEPEHEKPYRLNTVGHPVLLYAPSVEALKVLCNDQLAELTIALEEAKTHKNVDKVCGYKFIDEFQLQGSCPPENPRVGFLATLPTSNIIVALKAILAQLDAKPDAKKWDLPHKKAFGATFASSSVKGSVAALFAGQGTQYLNMFSDVAMNWPPFRDSIVAMEEAQTEVFEGQVEPISKVLFPRERYASESEQGNELLCLTEYSQPTTIAAAVGAFDIFKAAGFKPDMVGGHSLGEFAALYAAGSISRDDLYKLVCKRAKAMANASDGAMAAVIGPDARLVTPQNSDVYVANFNSATQVVISGTVQGVKEESKLLISKGFRVLPLKCQGAFHSPLMGPSEDSFKSLVETCTISPPKNVKFFCNVSGKESPNPKQTLKSHMTSSVQFEEQIRNMYDAGARVFLEFGPRQVLAKLIAEMFPSCTAISVNPASSGDSDVQLRLAAVKFAVSGAALSTFDPWEYRKPQDLLIRKPRKTALVLSAATYVSPKTLAERKKAMEDIKLVSITPRDSMVSIGKIAQEVRTAKQPLETEIRRLNKELEHLKRELAAAKASVKSASKSSKERSVLSKHRALLQNILQDYDDLRVVPFAVRSVAVDNTAPYADQVSTPASERSASPLFEKRSSVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVLSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGGPQGQTLTSEPIHQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKMELGGPQGQTLTAESIRQPPVSEPAVPTSSSSSIANVSSARLAEAEAAVLSVLADKTGYDSSMIEMDMDLESELGVDSIKRVEIMSEVQALLSVEVSDVDALSRTKTVGDVIEAMKMELGGPQGQTLTAESIREPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGESSSIETLNCTEVEHTSYKSVKASGCENVDTRFAKVVQISLPSKLKSTVSHDRPVIVVDDGTPLTTELCKILGGNIVVLSYQGKPAGPRGVEVPDLSEEALIQALALIRSTYGVPIGFICQQVSNVSTKAQLCWALLAAKHLKKDLNAVLPDSRSFFVGVVRLNGKLGTFENISDFSKFDLTKALDYGQRGSLLGLCKSLDLEWEQVFCRGIDLACDLMPLQAARILRNELQCPNMRLREVGYDISGARYTISTDDLLCGPSKAKVEAADLFLVTGGARGITPHCVREIASRSPGTTFVLVGRSEMSDEPDWAVGHYNKDLDQSTMKHLKATHAAGGVKPTPKAHRALVNRVTGSREVRESLRAIQEAGANVEYIACDVSDENKVRQLVQRVEQKYGCEITGIWHASGVLRDKLVEQKTTDDFEAVFGTKVTGLVNIVSQVNMSKLRHFILFSSLAGFHGNKGQTDYAIANEALNKIAHTLSAFLPKLNAKVLDFGPWVGSGMVTETLEKHFKAMGVQTIPLEPGARTVAQIILASSPPQSLLGNWGFPATKPLQRSNVVTGTLSPEEIEFIADHKIQGRKVLPMMAAIGFMASIAEGLYPGYNLQGVENAQLFQGLTINQETKFQITLIEEHNSEENLDVLTSLGVMLESGKVLPAYRCVVCLNTTQQQPKLSPKILNLEVDPACEVNPYDGKSLFHGPLLQFVQQVLHSSTKGLVAKCRALPIKEAIRGPFIKQTLHDPILDDVIFQLMLVWCRNALGSASLPNRIEKMSYFGNVSEGSTFFASVTPVGPRVPKDPVIKMQFLLQDESGNTFSSGEGSVVLSDELVF

SEQ ID NO: 40 - DNA, 1500 bp, Thraustochytrium sp.
  CDS (1)..(1500)
atgaaggacatggaagatagacgggtcgctattgtgggcatgtcagctcacttgccttgtgggacagatgtgaaggaatcatggcaggctattcgcgatggaatcgactgtctaagtgacctacccgcggatcgtctcgacgttacagcttactacaatcccaacaaagccacgaaagacaagatctactgcaaacggggtggcttcatcccgaactatgacttcgacccccgcgaatttgggctcaacatgtttcaaatggaagactctgatgcgaatcagacacttaccttgctcaaagtcaaacaagctctcgaagatgcaagcatagagcctttcaccaaggagaagaagaacattggatgtgttttaggtattggtgggggccaaaaggcgagtcatgagttctactctcgtctcaactacgttgtcgttgaaaaggtacttcggaaaatgggtttaccagatgctgatgttgaagaagctgtggagaaatacaaggcaaattttcccgagtggcgcctagactctttccctgggtttcttgggaatgtaacggctggtcggtgcagtaacaccttcaacatggaaggtatgaactgcgttgtggatgctgcatgtgccagttctctaattgcaatcaaggttgcagttgaagagctactctttggtgactgtgacaccatgattgcaggtgccacctgcacggacaattcacttggcatgtacatggccttctctaaaacgccagttttttctactgacccaagtgtccgcgcgtatgatgagaaaacaaaagggatgctaattggagaaggttcagcaatgttcgttcttaaacgctatgcggatgccgtacgtgatggcgacacaattcacgcggttctgcgttcttgctcttcgtctagtgatggaaaagcggcaggaatttatactcctactatatctggacaagaagaagctttgcgtcgagcgtatgcccgtgcgggggtatgtccatctacgatcgggcttgttgagggtcacgggacagggacccctgttggagatcgcattgagttaacagctctgcggaacttgtttgacaaagcttttggtagcaagaaggaacaaatagcagttggcagcataaagtctcagataggtcacctgaaatctgttgccggctttgccggcttggtcaaagctgtgcttgcgcttaaacacaaaacgctcccaggttcgattaatgtcgaccagccacctttgttgtatgacggtactcaaattcaagactcttctttatatatcaacaagacaaatagaccatggtttacgcaaaacaagcttccgcgtcgggctggtgtctcaagttttggatttggaggtgcaaactaccacgcggttctggaagaattcgagcccgagcatgaaaaaccataccgcctcaatactgttggacatcctgtcctcttgtacgctccgtctgtggaagccctcaaagtactttgcaacgaccag

SEQ ID NO: 41 - protein, 500 aa, Thraustochytrium sp.
MKDMEDRRVAIVGMSAHLPCGTDVKESWQAIRDGIDCLSDLPADRLDVTAYYNPNKATKDKIYCKRGGFIPNYDFDPREFGLNMFQMEDSDANQTLTLLKVKQALEDASIEPFTKEKKNIGCVLGIGGGQKASHEFYSRLNYVVVEKVLRKMGLPDADVEEAVEKYKANFPEWRLDSFPGFLGNVTAGRCSNTFNMEGMNCVVDAACASSLIAIKVAVEELLFGDCDTMIAGATCTDNSLGMYMAFSKTPVFSTDPSVRAYDEKTKGMLIGEGSAMFVLKRYADAVRDGDTIHAVLRSCSSSSDGKAAGIYTPTISGQEEALRRAYARAGVCPSTIGLVEGHGTGTPVGDRIELTALRNLFDKAFGSKKEQIAVGSIKSQIGHLKSVAGFAGLVKAVLALKHKTLPGSINVDQPPLLYDGTQIQDSSLYINKTNRPWFTQNKLPRRAGVSSFGFGGANYHAVLEEFEPEHEKPYRLNTVGHPVLLYAPSVEALKVLCNDQ

SEQ ID NO: 42 - DNA, 1500 bp, Thraustochytrium sp.
  CDS (1)..(1500)
cttgcggagctcacaattgcattggaagaggcaaaaacacataaaaatgttgacaaagtttgtggctacaagtttattgacgaatttcagctccaaggaagctgtcctccagaaaatccgagagtaggatttttagcaacactgcctacttcaaatatcattgtcgcgcttaaggcaattctcgcgcagcttgatgcaaaaccagatgcgaagaaatgggatttgcctcataaaaaggcttttggggctaccttcgcatcgtcttcagtgaaaggctctgttgctgcgctcttcgcaggacagggtacccagtacttaaacatgttctctgatgtggcaatgaactggccaccgttccgtgacagcattgtcgcaatggaagaagctcaaactgaggtatttgagggccaagttgaaccaattagcaaagttctgtttccacgagagcgctatgcatccgaaagtgaacaggggaatgaacttctttgcttaacagagtactctcagccaactacgatagcagccgcagtaggggccttcgatattttcaaagcggctggctttaagccagacatggttggagggcattcacttggcgaatttgctgctttgtacgcggctgggtccatttcgcgtgacgacctgtacaagcttgtgtgcaaacgggcaaaggcaatggcgaacgctagtgacggagctatggcagcagtgattggcccagatgcacgtctagttacgccacaaaatagtgacgtttatgtcgcaaacttcaactccgcaactcaagtagtcatcagtggcactgttcaaggtgtgaaagaagagtcgaaattgctcatttcaaaggggttccgcgtactgccacttaaatgccagggcgccttccattctcctttgatggggccttctgaggatagtttcaaatcacttgtggagacttgtaccatctcgccgccaaaaaatgtgaaattcttttgcaatgttagtggcaaggaaagcccaaacccaaaacagaccctcaagtcacacatgacgtctagcgttcagttcgaggagcagattcgtaacatgtacgatgccggagcacgtgtttttctggagtttggaccccgccaagtccttgcaaagcttatcgcggaaatgtttccctcgtgtacagctatcagcgttaaccccgcgagcagtggtgacagtgacgtgcaactccgcctcgccgccgtaaaattcgcggtctcgggtgcagcccttagcacctttgatccatgggagtatcgcaagccacaagatcttcttattcgaaaaccacgaaaaactgcccttgttctatcagcagcaacatatgtttccccaaagactcttgcagaacgtaaaaaggctatggaagatatcaagctagtatccattacaccaagagatagtatggtatcaattggaaaaatcgcgcaagaagtacggacagctaaacagcctttagaaaccgaaattcgaagactcaacaaa

SEQ ID NO: 43 - protein, 500 aa, Thraustochytrium sp.
LAELTIALEEAKTHKNVDKVCGYKFIDEFQLQGSCPPENPRVGFLATLPTSNIIVALKAILAQLDAKPDAKKWDLPHKKAFGATFASSSVKGSVAALFAGQGTQYLNMFSDVAMNWPPFRDSIVAMEEAQTEVFEGQVEPISKVLFPRERYASESEQGNELLCLTEYSQPTTIAAAVGAFDIFKAAGFKPDMVGGHSLGEFAALYAAGSISRDDLYKLVCKRAKAMANASDGAMAAVIGPDARLVTPQNSDVYVANFNSATQVVISGTVQGVKEESKLLISKGFRVLPLKCQGAFHSPLMGPSEDSFKSLVETCTISPPKNVKFFCNVSGKESPNPKQTLKSHMTSSVQFEEQIRNMYDAGARVFLEFGPRQVLAKLIAEMFPSCTAISVNPASSGDSDVQLRLAAVKFAVSGAALSTFDPWEYRKPQDLLIRKPRKTALVLSAATYVSPKTLAERKKAMEDIKLVSITPRDSMVSIGKIAQEVRTAKQPLETEIRRLNK

SEQ ID NO: 44 - DNA, 351 bp, Thraustochytrium sp.
  CDS (1)..(351)
tcgaccccagcgtcagagcggtcggcttcaccgcttttcgagaaacgcagttcggtttcgtcagcacgcctcgctgaagctgaagccgcggtactgagcgttctcgcagacaagacaggctacgacagctcaatgatcgagatggacatggacctggagagtgagcttggcgttgatagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgaccgcggaatcgatccgtcagcca

SEQ ID NO: 45 - protein, 117 aa, Thraustochytrium sp.
STPASERSASPLFEKRSSVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQP

SEQ ID NO: 46 - protein, 5 aa, Thraustochytrium sp.
  MISC_FEATURE (1)..(5): Xaa = any amino acid
LGXDS

SEQ ID NO: 47 - DNA, 2790 bp, Thraustochytrium sp.
  CDS (1)..(2790)
tcgaccccagcgtcagagcggtcggcttcaccgcttttcgagaaacgcagttcggtttcgtcagcacgcctcgctgaagctgaagccgcggtactgagcgttctcgcagacaagacaggctacgacagctcaatgatcgagatggacatggacctggagagtgagcttggcgttgatagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgaccgcggaatcgatccgtcagccaccggtgtccgagcctgctgtaccgacctcatcgtcaagcagtattgctaatgtttcgtcagcacgcctcgctgaagctgaagctgcggtactgagcgttctcgcagacaagacaggctacgacagctcaatgatcgagatggacatggacctggagagcgagcttggcgttgatagcatcaaacgcgtggagatcatgagcgaggttcaaacgctgctcagcgtggaagtctccgacgttgacgctctgtcaagaactaagactgttggcgacgtcatcgaggcgatgaagctggaactcggtggaccccaaggccagactttgaccgcggaatcgatccgtcagccaccggtgtctgagcctgctgtaccgacctcatcgtcaagcagtattgctaatgtttcgtcagcacgcctcgctgaagctgaagcggcggtactgagcgttctcgcagacaagacaggctacgacagctcaatgatcgagatggacatggacctggagagcgagcttggcgtcgacagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgaccgcggaatcgatccgtcagccaccggtgtccgagcctgctgtaccgacctcatcgtcaagcagtattgctaatgttttgtcagcacgcctcgctgaagctgaagccgcggtactgagcgttctcgcagacaagacaggctacgacagctcaatgatcgagatggacatggacctggagagcgagcttggcgttgatagcatcaaacgcgtggagatcatgagcgaggttcaaacgttgctcagcgtggaagtctccgacgttgacgctctgtcaagaaccaagactgttggcgacgtcatcgaggcgatgaagctggaactcggtggaccccaaggccagactttgaccgcggaatcgatccgtcagccaccggtgtctgagcctgctgtaccgacctcatcgtcaagcagtattgctaatgtttcgtcagcacgcctcgctgaagctgaagccgcggtactgagcgttctcgcagacaagacaggctacgacagctcaatgatcgagatggacatggacctggagagtgagcttggcgtcgacagcatcaaacgcgtggagatcatgagcgaggttcaaacgctgctcagcgtggaagtctccgacgttgacgctctgtcaagaaccaagactgttggcgacgtcatcgaggcgatgaagctggaactcggtggaccccaaggccagactttgacctctgaaccgatccatcagccaccagtgtccgagcctgctgtaccgacctcatcgtcaagcagtattgctaatgtttcttcagcacgcctcgctgaagctgaagccgcggtactgagcgttctcgcagacaagacaggctacgacagctcaatgatcgagatggacatggacctggagagcgagcttggcgttgatagcatcaaacgcgtggaaatcatgagcgaggttcaaacgctgctcagcgtggaagtctccgacgttgacgctctgtcaagaaccaagactgttggcgacgtcatcgaggcgatgaagatggaactcggtggaccccaaggccagactttgaccgcggaatcgatccgtcagccaccggtgtctgagcctgctgtaccgacctcatcgtcaagcagtattgctaatgtttcgtcagcacgcctcgctgaagctgaagcggcggtactgagcgttctcgcagacaagacaggctacgacagctcaatgatcgagatggacatggacctggagagcgagcttggcgttgatagcatcaaacgcgtggagatcatgagcgaggttcaagcgctgctcagcgtggaagtctccgacgttgacgctctgtcaagaaccaagactgttggcgacgtcatcgaggcgatgaagatggaactcggtggaccccaaggccagactttgaccgcagaatcgatccgtgagccaccggtgtctgagcctgctgtaccgacctcatcgtcaagtagtatcgctaatgtttcttcagctcgcctcgctgaagctgaagccgcggtactgagcgttctcgcagacaagacaggctacgacagctcaatgatcgagatggacatggacctggagagtgagcttggcgtcgacagcatcaaacgcgtggagatcatgagcgaggttcaaacgttgctcagcgtggaagtctccgacgttgacgctctgtcaagaaccaagactgttggcgacgtcatcgaggcgatgaagctggaacttggggaatcatcaagtattgagactctcaattgtaccgaggttgagcacacg

SEQ ID NO: 48 - protein, 930 aa, Thraustochytrium sp.
STPASERSASPLFEKRSSVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVLSARLAEAEAAVLSVLADKTGYDSSMIEMDMDLESELGVDSIKRVEIMSEVQTLLSVEVSDVDALSRTKTVGDVIEAMKLELGGPQGQTLTAESIRQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGGPQGQTLTSEPIHQPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKMELGGPQGQTLTAESIRQPPVSEPAVPTSSSSSIANVSSARLAEAEAAVLSVLADKTGYDSSMIEMDMDLESELGVDSIKRVEIMSEVQALLSVEVSDVDALSRTKTVGDVIEAMKMELGGPQGQTLTAESIREPPVSEPAVPTSSSSSIANVSSARLAEAEAAVLSVLADKTGYDSSMIEMDMDLESELGVDSIKRVEIMSEVQTLLSVEVSDVDALSRTKTVGDVIEAMKLELGESSSIETLNCTEVEHT

SEQ ID NO: 49 - DNA, 2433 bp, Thraustochytrium sp.
  CDS (1)..(2433)
aaaagtgtcaaggcttcagggtgtgagaatgtagatacccgtttcgctaaggttgtacaaatctcgcttcctagcaagctgaaatccactgtgtcgcacgatcgacctgtaattgttgtagatgatggaacgcccttaaccacggagctttgtaaaattcttgggggtaatattgtggttctctcttatcaagggaagcccgctggtccacggggagtcgaggtgccagatctttccgaggaagccctaattcaagctcttgcattgattcggtctacatatggagttccaattggttttatttgtcagcaagtgtctaatgtgagcaccaaggcacagctttgttgggcactcctcgcagcgaagcatctcaagaaggatttgaatgctgtcttacccgattcaagatccttcttcgtcggagttgtacgcttgaacgggaaacttggaactttcgaaaacatcagcgacttctctaaatttgatttgacgaaagccctagattacggacagcgtggttctctcttaggcctgtgcaagtcactagacttagaatgggaacaggtgttttgccgtggaatagatcttgcgtgtgatcttatgccactccaggccgcaaggatactcagaaatgagcttcagtgtcccaatatgcgccttcgcgaggttgggtacgatatttctggcgccaggtacaccatttcaaccgatgacctgctatgtggaccctcgaaggctaaagtagaggccgcagacttgtttcttgtgacaggtggcgcacgaggtattacacctcattgtgttcgtgagattgcaagtcgatcccccggaaccacatttgtgctggttggaagaagcgaaatgtccgacgagcctgactgggctgttggccactacaataaagacctggaccaaagcacaatgaaacacttgaaagcaacgcatgctgctggaggggtaaaacctacgcctaaagcacatcgtgcacttgtgaacagggtcactggctcacgggaggtacgagaatctcttagagcaatccaggaggcaggggcaaatgtcgaatatatcgcctgtgatgtttcggatgaaaacaaggtccgccaacttgtgcaaagagtggagcaaaagtatggctgtgaaataactgggatttggcatgcaagcggggttcttcgtgacaaacttgtcgagcaaaagactacagacgactttgaggcagtttttgggaccaaggtgactggccttgtaaacatcgtgtcacaagtcaatatgtctaagctacgacacttcatcctcttcagttctttggctggatttcatgggaacaagggccaaacggattatgcaattgctaatgaagccttgaacaaaatcgcgcatactctctcagcgtttttgcccaaactgaatgcaaaggtgctagacttcggtccgtgggtaggttcaggaatggtaaccgaaacacttgagaagcattttaaagctatgggggttcagactattcctctcgagccaggagcacggactgttgcgcaaatcattttggcaagttcgccaccgcaatcgcttttggggaactggggctttccagccaccaaaccgctacaacgctctaatgtagtcacgggcacactctctccggaagagatagaattcatcgcagaccacaaaattcaaggccgcaaggtgcttcccatgatggctgcaatcgggttcatggcctctattgcggaaggactctacccggggtacaatctgcaaggcgtggaaaatgctcagctctttcaaggcttgactatcaaccaagagacaaaatttcaaatcactctcattgaggagcacaactctgaggaaaacctggatgtcctgacatcccttggtgtaatgttggaaagcgggaaggtgcttcccgcttaccgatgtgttgtatgcttgaatacaacccagcagcagcccaagctatctccaaaaattcttaacttggaagttgaccctgcatgcgaggttaacccctatgatggaaagtcgttgttccacggtccgcttttgcaattcgttcaacaagtgttgcactcaagtaccaaaggcctcgttgccaagtgccgcgcgcttccaatcaaagaagccatccgagggccatttatcaagcaaacactccatgatccaattctagacgacgtcatttttcagctaatgctcgtgtggtgtcgtaatgctctaggaagtgcatcgctacccaacagaattgaaaagatgtcatactttgggaatgtctcagaaggtagcactttctttgcctcagttacacctgtgggaccaagagtaccaaaggatcccgtgatcaaaatgcagtttcttctccaagatgaatccggcaacacattttcatcgggggagggctcggttgtgcttagtgacgaactcgtcttt

SEQ ID NO: 50 - protein, 811 aa, Thraustochytrium sp.
KSVKASGCENVDTRFAKVVQISLPSKLKSTVSHDRPVIVVDDGTPLTTELCKILGGNIVVLSYQGKPAGPRGVEVPDLSEEALIQALALIRSTYGVPIGFICQQVSNVSTKAQLCWALLAAKHLKKDLNAVLPDSRSFFVGVVRLNGKLGTFENISDFSKFDLTKALDYGQRGSLLGLCKSLDLEWEQVFCRGIDLACDLMPLQAARILRNELQCPNMRLREVGYDISGARYTISTDDLLCGPSKAKVEAADLFLVTGGARGITPHCVREIASRSPGTTFVLVGRSEMSDEPDWAVGHYNKDLDQSTMKHLKATHAAGGVKPTPKAHRALVNRVTGSREVRESLRAIQEAGANVEYIACDVSDENKVRQLVQRVEQKYGCEITGIWHASGVLRDKLVEQKTTDDFEAVFGTKVTGLVNIVSQVNMSKLRHFILFSSLAGFHGNKGQTDYAIANEALNKIAHTLSAFLPKLNAKVLDFGPWVGSGMVTETLEKHFKAMGVQTIPLEPGARTVAQIILASSPPQSLLGNWGFPATKPLQRSNVVTGTLSPEEIEFIADHKIQGRKVLPMMAAIGFMASIAEGLYPGYNLQGVENAQLFQGLTINQETKFQITLIEEHNSEENLDVLTSLGVMLESGKVLPAYRCVVCLNTTQQQPKLSPKILNLEVDPACEVNPYDGKSLFHGPLLQFVQQVLHSSTKGLVAKCRALPIKEAIRGPFIKQTLHDPILDDVIFQLMLVWCRNALGSASLPNRIEKMSYFGNVSEGSTFFASVTPVGPRVPKDPVIKMQFLLQDESGNTFSSGEGSVVLSDELVF

SEQ ID NO: 51 - DNA, 5808 bp, Thraustochytrium sp.
  CDS (1)..(5805)
  misc_feature (1)..(5808): n = a c t or g
atgcaacttcctccagcgcattctgccgatgagaatcgcatcgcggtcgtgggcatggccgtcaaatatgcgggctgtgacaataaagaagagttttggaagactttgatgaatggtagtatcaataccaagtcgatttcggcagcaaggttgggcagcaataagcgtgacgaacactatgttcctgaacgatcgaaatatgcagatacgttctgtaacgaaaggtacggttgtatccagcaaggtacggataatgagcatgacctcctcctaggtcttgctcaagaagctctcgctgacgctgccgggcggatggagaaacaaccttcggaggcgttcgatctggaaaatactggcatcgtgagtgggtgcttatcttttccaatggataacctgcaaggagagttgttgaacttgtatcaaagccatgtggagaaacaacttccacctagtgccttggtagaagccgtgaagctttggtctgagcgacagaaatctacgaaagcacatgcaggggacaagcgccggttcattgacccagcttcttttgtagctgataaactgaacctaggcccactacattatgcgatcgatgcagcatgcgcttctgcattgtacgtgttaaaattagctcaagaccaccttgtttcaggtgccgttgatatgatgttatgtggagcgacgtgcttcccagaaccattcttcatcttgtctgggttctcgacttttcaagcgatgcctgntggggcagatggagtctcactacctctccataaaacgagtgctgggctcactccaggtgaaggggggtccattatggtgctcaagcgactgaaagacgctatcagagatggaaatcacatttatggtgtgctccttgaagcaaatttaagtaacgcaggttgtgggcttccactcagcccgcacttaccgagcgaagaatcatgtattcgtgatacctaccgccgtgctggagttgctgcagatcaaagtattcagtatattgagtgccacgctacgggaacccctcgaggggatgtcgtggaaattgaggcggttgaaagagttttcaagaaaaacgttccacgcttaggctcgacgaaaggaaattttggtcactcgttagttgcggctggtttcgcaggtatggcaaagcttcttcttgcaatggaacatggagtgattcctcccacaccaggtcttgatgcttcgaaccaggcaagtgagcacgttgtgacaaaggctatcacttggcctgagacacatggggctccaaaacgagctggcctttcagcatttggatttggtgggactaatgcgcatgcactcttcgaagagtttaatgccgagggcataagttatcgccctggaaagcctccagtcgaatcgaatacccgtccttccgtcgtaataactgggatggactgtacctttgggagccttgaagggattgatgcgttcgagactgccctgtacgaggggcgtgacgcagctcgtgacttacccgccaaacgttggaggttcctaggtgaggacttggagtttctccgagccatcaggctcaaggaaaagcctaggggttgttttgtggagagtgttgacgttaactttagacggctgaaaacgcccttgacaccagaagatatgttgcggccccaacaactcttggcggtttctacgatggaccgagcaattatcgatgcaggtctaaagaagggccaacatgtagcagttcttgttggcctaggaactgacctggaactttaccgtcatcgagcaagagtcgcgcttaaagaggttttgcacccgagcttaaagtcagacactgcaattctccagaaaataatgcaatatgtgaatgatgcaggaacttcgacttcatacacatcttacattggaaacctcgttgccacgcgtatttcgtctcagtggggattcacagggccgtcctttactgtcacagaaggaaataattccgtgtacagatgtgcacaactagccaaagatatgcttcaggttaaccgagttgatgctgtcgtcatcgcaggcgttgatctcaacggaagcgccgaaagtttttttgtccgagcaaatcgtcaaaagatatccaagctaagtcatccatgtgcaagcttcgacagagatgcagatggatttttcgcaggtgagggctgtggtgccctagttttcaagaggttagaagactgtgctcctcaggaaaaaatttatgctagtatagactctatcgcaatagataaagagcctactagctcagctgtgaaagctgtctaccaaagtgattcgagtctctccgatattgagctgttagaaatcagtggagactccaaacggtttgcagcattcgaaggcgctgtggaaattcaatcaagtgtggaagcccagctaaaaggactttccaaagtccttgaacctgcaaaaggccaaggcgtagcggtgggaagtactcgagcaaccgttggggatatagggtatgctacaggagcggcaagcctgattaaaactgcactctgcttatataatcgctaccttccggcattagcaaactggagtggcccatgtgaacagtccgcctggggctcaaacatgttcgtttgccatgaaacacggccgtggatgaaaaaccagaatgaaaagagatgtgccctcatttctggaacagatccatctcatacatgcttttccctcgtactatcggatactgggtgttatgaagagcacaatcgaacgtgctttgatgtgcaagcgccacagctagttctgatacacggattcgatggaaaaactattgtgcggcgacttgaaggatatctccttgaacttgttgaagggcatgcaagcccttcagagtatttccacaaactgattggacaaagtctacttgagaactcgaaagaaagtaaactcacactttcgcttgtgtgcaatccgaaccagctccaaaaggagctcatgcttgctatcaaaggagtacaacgaagcatgttaacagggaaggattgggtcagtccatcaggaagttgttttgccccaaatccgttatcaagcgcaaaagtggcattcatgtacggagaaggccgaagcccgtactgtggtgtaggcttgggtctacatcgtttgtggcccggtctccatgaaaatgtgaacaataagacagtcgatttatggacggaaggagatggttggttatatcctcgaacgttgacacgagaagagcatacaaaagccatcgaatctttcaacgcaaatcaaattgaaatgtttcgcgctgggattttcatctcaatgtgtcagacagactatgtcatgaatgttctcggtgtccagcctaaggccggatttgggctgagcttgggagaaatttcaatgctctttgcgatgtcaaaggagaactgcaggcagtcacaggaaatgaccaatcgtttgcgcggttctccagtgtggtctaacgagcttgctatcaacttcaatgcaattcgcaagttatggaaaatcccccgaggagctcccttagaatccttttggcaaggatacttggttcacggcacaagagaagaagtagagcatgctattggtctttctgagccttatgtacgtctgcttattgtgaacgattcaaggagtgccttgattgctggaaaaccagacgcctgtcaggcagtaatcagtagactaaactccaagttcccttctctgccggtaaagcaaggaatgattggtcattgcccagaagttcgtgcgttcatcaaagatattgggtacatccatgaaacactccgaatttccaatgactattcggattgtcagcttttctcagcggtaaccaagggcgcacttgacagctccacaatggaaatcaaacactttgtgggagaggtctactcccggatcgcagactttcctcaaatcgtcaacacggtgcattcggctggttatgacgtatttcttgagcttggctgtgatgcttctagatctgcagcagttcaaaacattcttggtggtcaaggaaagttcttgtctacagctattgacaaaaaaggacactccgcctggtcacaagtacttcgggctaccgcatcattagctgcacatcgagtaccgggaatctcaattttggatttgtttcacccaaatttccgagaaatgtgctgtacaatggcaaccacacctaaagtggaagataagttcctgcgcacgattcaaatcaatggtcggtttgaaaaagaaatgattcacctagaagatacaacattaagttgcttacccgctccaagtgaagcaaatatcgcagctattcaatctcggtcaattcgatctgctgcggcgcgttctggacaatcccatgattgtgcatcccatagccatgaagaaaataaggattcatgccctgaaaagctgaagcttgattctgtgtccgtcgccataaatttcgacaatgatgaccgcattcagcttgggcacgcgggttttcgggagatgtacaatacaagatatagcttgtacacaggggcgatggcaaagggaattgcatctgcagatcttgtcattgccgctgggaaagagggcatcctagcttcctatggagctggaggactacctcttgctactgttcgaaagggaatagacaaaattcaacaagccttgccaagtggcccatatgctgtaaatcttattcactctccctttgacggcaacttggagcagggaaacgtcgatttgttcttggaaaagaacgtccgcgtggcggaatgttccgcgtttacaacgctaacagtgccagtagtacactatcgtgctgcagggcttgttcggcgccaagatggaagcattttgatcaagaaccgaatcattgctaaagtatctaggacagaactcgctgagatgttccttcgtccggcacctcaaatcatcctcgaaaaactggtagcagcagaaatcatttcatctgaccaagcgcgtatggcagccaaagttcccatggcggacgacatcgcagtcgaagccgactctggtgggcacacggataatcggcctatgcacgtcattttgcccctgataattcaactccgcaatactatacttgcagagtatggctgtgccacggcttttcgtacccgtataggcgctggaggaggcattggttgtccttcagcggccctcgcagcctttgatatgggtgcgagttttgtcgtgactggaagcataaatcaaatttgccgcgaggcagggacttgcgatactgttcgggagctacttgccaactcaagctactcggacgtgacgatggcgccagcagcagacatgtttgaccaaggtgtgaaactccaagtcttaaaacgaggaacgatgtttccaagcagagcaaataaactccggaagctctttgtgaactacgaatctctagaaacactcccgtcgaaagagttgaaatacctggaaaacatcatattcaagcaagcagtagaccaggtgtgggaggaaacaaagcgcttttactgtgaaaaactgaacaatccagataaaattgcaagggccatgaaagatcctaaattgaagatgtcgctttgctttcggtggtatctctccaagagctctgggtgggccaacgcaggaattaaatctcgtgcactcgactaccagatctggtgtggcccggcaatgggctcgttcaacaatttcgccagcggcacatccctcgattggaaagtgactggggttttccctggcgttgcggaagtaaacatggccattttagatggcgcgcgagaactagctgctaaacgaaattaa

SEQ ID NO: 52 - protein, 1935 aa, Thraustochytrium sp.
  misc_feature (248)..(248): The 'Xaa' at location 248 stands for Asp, Gly, Ala, or Val.
MQLPPAHSADENRIAVVGMAVKYAGCDNKEEFWKTLMNGSINTKSISAARLGSNKRDEHYVPERSKYADTFCNERYGCIQQGTDNEHDLLLGLAQEALADAAGRMEKQPSEAFDLENTGIVSGCLSFPMDNLQGELLNLYQSHVEKQLPPSALVEAVKLWSERQKSTKAHAGDKRRFIDPASFVADKLNLGPLHYAIDAACASALYVLKLAQDHLVSGAVDMMLCGATCFPEPFFILSGFSTFQAMPXGADGVSLPLHKTSAGLTPGEGGSIMVLKRLKDAIRDGNHIYGVLLEANLSNAGCGLPLSPHLPSEESCIRDTYRRAGVAADQSIQYIECHATGTPRGDVVEIEAVERVFKKNVPRLGSTKGNFGHSLVAAGFAGMAKLLLAMEHGVIPPTPGLDASNQASEHVVTKAITWPETHGAPKRAGLSAFGFGGTNAHALFEEFNAEGISYRPGKPPVESNTRPSVVITGMDCTFGSLEGIDAFETALYEGRDAARDLPAKRWRFLGEDLEFLRAIRLKEKPRGCFVESVDVNFRRLKTPLTPEDMLRPQQLLAVSTMDRAIIDAGLKKGQHVAVLVGLGTDLELYRHRARVALKEVLHPSLKSDTAILQKIMQYVNDAGTSTSYTSYIGNLVATRISSQWGFTGPSFTVTEGNNSVYRCAQLAKDMLQVNRVDAVVIAGVDLNGSAESFFVRANRQKISKLSHPCASFDRDADGFFAGEGCGALVFKRLEDCAPQEKIYASIDSIAIDKEPTSSAVKAVYQSDSSLSDIELLEISGDSKRFAAFEGAVEIQSSVEAQLKGLSKVLEPAKGQGVAVGSTRATVGDIGYATGAASLIKTALCLYNRYLPALANWSGPCEQSAWGSNMFVCHETRPWMKNQNEKRCALISGTDPSHTCFSLVLSDTGCYEEHNRTCFDVQAPQLVLIHGFDGKTIVRRLEGYLLELVEGHASPSEYFHKLIGQSLLENSKESKLTLSLVCNPNQLQKELMLAIKGVQRSMLTGKDWVSPSGSCFAPNPLSSAKVAFMYGEGRSPYCGVGLGLHRLWPGLHENVNNKTVDLWTEGDGWLYPRTLTREEHTKAIESFNANQIEMFRAGIFISMCQTDYVMNVLGVQPKAGFGLSLGEISMLFAMSKENCRQSQEMTNRLRGSPVWSNELAINFNAIRKLWKIPRGAPLESFWQGYLVHGTREEVEHAIGLSEPYVRLLIVNDSRSALIAGKPDACQAVISRLNSKFPSLPVKQGMIGHCPEVRAFIKDIGYIHETLRISNDYSDCQLFSAVTKGALDSSTMEIKHFVGEVYSRIADFPQIVNTVHSAGYDVFLELGCDASRSAAVQNILGGQGKFLSTAIDKKGHSAWSQVLRATASLAAHRVPGISILDLFHPNFREMCCTMATTPKVEDKFLRTIQINGRFEKEMIHLEDTTLSCLPAPSEANIAAIQSRSIRSAAARSGQSHDCASHSHEENKDSCPEKLKLDSVSVAINFDNDDRIQLGHAGFREMYNTRYSLYTGAMAKGIASADLVIAAGKEGILASYGAGGLPLATVRKGIDKIQQALPSGPYAVNLIHSPFDGNLEQGNVDLFLEKNVRVAECSAFTTLTVPVVHYRAAGLVRRQDGSILIKNRIIAKVSRTELAEMFLRPAPQIILEKLVAAEIISSDQARMAAKVPMADDIAVEADSGGHTDNRPMHVILPLIIQLRNTILAEYGCATAFRTRIGAGGGIGCPSAALAAFDMGASFVVTGSINQICREAGTCDTVRELLANSSYSDVTMAPAADMFDQGVKLQVLKRGTMFPSRANKLRKLFVNYESLETLPSKELKYLENIIFKQAVDQVWEETKRFYCEKLNNPDKIARAMKDPKLKMSLCFRWYLSKSSGWANAGIKSRALDYQIWCGPAMGSFNNFASGTSLDWKVTGVFPGVAEVNMAILDGARELAAKRN

SEQ ID NO: 53 - DNA, 1500 bp, Thraustochytrium sp.
  CDS (1)..(1500)
  misc_feature (1)..(1500): n = a c t or g
atgcaacttcctccagcgcattctgccgatgagaatcgcatcgcggtcgtgggcatggccgtcaaatatgcgggctgtgacaataaagaagagttttggaagactttgatgaatggtagtatcaataccaagtcgatttcggcagcaaggttgggcagcaataagcgtgacgaacactatgttcctgaacgatcgaaatatgcagatacgttctgtaacgaaaggtacggttgtatccagcaaggtacggataatgagcatgacctcctcctaggtcttgctcaagaagctctcgctgacgctgccgggcggatggagaaacaaccttcggaggcgttcgatctggaaaatactggcatcgtgagtgggtgcttatcttttccaatggataacctgcaaggagagttgttgaacttgtatcaaagccatgtggagaaacaacttccacctagtgccttggtagaagccgtgaagctttggtctgagcgacagaaatctacgaaagcacatgcaggggacaagcgccggttcattgacccagcttcttttgtagctgataaactgaacctaggcccactacattatgcgatcgatgcagcatgcgcttctgcattgtacgtgttaaaattagctcaagaccaccttgtttcaggtgccgttgatatgatgttatgtggagcgacgtgcttcccagaaccattcttcatcttgtctgggttctcgacttttcaagcgatgcctgntggggcagatggagtctcactacctctccataaaacgagtgctgggctcactccaggtgaaggggggtccattatggtgctcaagcgactgaaagacgctatcagagatggaaatcacatttatggtgtgctccttgaagcaaatttaagtaacgcaggttgtgggcttccactcagcccgcacttaccgagcgaagaatcatgtattcgtgatacctaccgccgtgctggagttgctgcagatcaaagtattcagtatattgagtgccacgctacgggaacccctcgaggggatgtcgtggaaattgaggcggttgaaagagttttcaagaaaaacgttccacgcttaggctcgacgaaaggaaattttggtcactcgttagttgcggctggtttcgcaggtatggcaaagcttcttcttgcaatggaacatggagtgattcctcccacaccaggtcttgatgcttcgaaccaggcaagtgagcacgttgtgacaaaggctatcacttggcctgagacacatggggctccaaaacgagctggcctttcagcatttggatttggtgggactaatgcgcatgcactcttcgaagagtttaatgccgagggcataagttatcgccctggaaagcctccagtcgaatcgaatacccgtccttccgtcgtaataactgggatggactgtacctttgggagccttgaagggattgatgcgttcgagactgccctgtacgaggggcgtgacgcagctcgtgac

SEQ ID NO: 54 - protein, 500 aa, Thraustochytrium sp.
  misc_feature (248)..(248): The 'Xaa' at location 248 stands for Asp, Gly, Ala, or Val.
MQLPPAHSADENRIAVVGMAVKYAGCDNKEEFWKTLMNGSINTKSISAARLGSNKRDEHYVPERSKYADTFCNERYGCIQQGTDNEHDLLLGLAQEALADAAGRMEKQPSEAFDLENTGIVSGCLSFPMDNLQGELLNLYQSHVEKQLPPSALVEAVKLWSERQKSTKAHAGDKRRFIDPASFVADKLNLGPLHYAIDAACASALYVLKLAQDHLVSGAVDMMLCGATCFPEPFFILSGFSTFQAMPXGADGVSLPLHKTSAGLTPGEGGSIMVLKRLKDAIRDGNHIYGVLLEANLSNAGCGLPLSPHLPSEESCIRDTYRRAGVAADQSIQYIECHATGTPRGDVVEIEAVERVFKKNVPRLGSTKGNFGHSLVAAGFAGMAKLLLAMEHGVIPPTPGLDASNQASEHVVTKAITWPETHGAPKRAGLSAFGFGGTNAHALFEEFNAEGISYRPGKPPVESNTRPSVVITGMDCTFGSLEGIDAFETALYEGRDAARD

SEQ ID NO: 55 - DNA, 1500 bp, Thraustochytrium sp.
  CDS (1)..(1500)
ttacccgccaaacgttggaggttcctaggtgaggacttggagtttctccgagccatcaggctcaaggaaaagcctaggggttgttttgtggagagtgttgacgttaactttagacggctgaaaacgcccttgacaccagaagatatgttgcggccccaacaactcttggcggtttctacgatggaccgagcaattatcgatgcaggtctaaagaagggccaacatgtagcagttcttgttggcctaggaactgacctggaactttaccgtcatcgagcaagagtcgcgcttaaagaggttttgcacccgagcttaaagtcagacactgcaattctccagaaaataatgcaatatgtgaatgatgcaggaacttcgacttcatacacatcttacattggaaacctcgttgccacgcgtatttcgtctcagtggggattcacagggccgtcctttactgtcacagaaggaaataattccgtgtacagatgtgcacaactagccaaagatatgcttcaggttaaccgagttgatgctgtcgtcatcgcaggcgttgatctcaacggaagcgccgaaagtttttttgtccgagcaaatcgtcaaaagatatccaagctaagtcatccatgtgcaagcttcgacagagatgcagatggatttttcgcaggtgagggctgtggtgccctagttttcaagaggttagaagactgtgctcctcaggaaaaaatttatgctagtatagactctatcgcaatagataaagagcctactagctcagctgtgaaagctgtctaccaaagtgattcgagtctctccgatattgagctgttagaaatcagtggagactccaaacggtttgcagcattcgaaggcgctgtggaaattcaatcaagtgtggaagcccagctaaaaggactttccaaagtccttgaacctgcaaaaggccaaggcgtagcggtgggaagtactcgagcaaccgttggggatatagggtatgctacaggagcggcaagcctgattaaaactgcactctgcttatataatcgctaccttccggcattagcaaactggagtggcccatgtgaacagtccgcctggggctcaaacatgttcgtttgccatgaaacacggccgtggatgaaaaaccagaatgaaaagagatgtgccctcatttctggaacagatccatctcatacatgcttttccctcgtactatcggatactgggtgttatgaagagcacaatcgaacgtgctttgatgtgcaagcgccacagctagttctgatacacggattcgatggaaaaactattgtgcggcgacttgaaggatatctccttgaacttgttgaagggcatgcaagcccttcagagtatttccacaaactgattggacaaagtctacttgagaactcgaaagaaagtaaactcacactttcgcttgtgtgcaatccgaaccagctccaaaaggagctcatgcttgctatcaaaggagtacaacgaagc

SEQ ID NO: 56 - protein, 500 aa, Thraustochytrium sp.
LPAKRWRFLGEDLEFLRAIRLKEKPRGCFVESVDVNFRRLKTPLTPEDMLRPQQLLAVSTMDRAIIDAGLKKGQHVAVLVGLGTDLELYRHRARVALKEVLHPSLKSDTAILQKIMQYVNDAGTSTSYTSYIGNLVATRISSQWGFTGPSFTVTEGNNSVYRCAQLAKDMLQVNRVDAVVIAGVDLNGSAESFFVRANRQKISKLSHPCASFDRDADGFFAGEGCGALVFKRLEDCAPQEKIYASIDSIAIDKEPTSSAVKAVYQSDSSLSDIELLEISGDSKRFAAFEGAVEIQSSVEAQLKGLSKVLEPAKGQGVAVGSTRATVGDIGYATGAASLIKTALCLYNRYLPALANWSGPCEQSAWGSNMFVCHETRPWMKNQNEKRCALISGTDPSHTCFSLVLSDTGCYEEHNRTCFDVQAPQLVLIHGFDGKTIVRRLEGYLLELVEGHASPSEYFHKLIGQSLLENSKESKLTLSLVCNPNQLQKELMLAIKGVQRS

SEQ ID NO: 57 - DNA, 1500 bp, Thraustochytrium sp.
  CDS (1)..(1500)
atgttaacagggaaggattgggtcagtccatcaggaagttgttttgccccaaatccgttatcaagcgcaaaagtggcattcatgtacggagaaggccgaagcccgtactgtggtgtaggcttgggtctacatcgtttgtggcccggtctccatgaaaatgtgaacaataagacagtcgatttatggacggaaggagatggttggttatatcctcgaacgttgacacgagaagagcatacaaaagccatcgaatctttcaacgcaaatcaaattgaaatgtttcgcgctgggattttcatctcaatgtgtcagacagactatgtcatgaatgttctcggtgtccagcctaaggccggatttgggctgagcttgggagaaatttcaatgctctttgcgatgtcaaaggagaactgcaggcagtcacaggaaatgaccaatcgtttgcgcggttctccagtgtggtctaacgagcttgctatcaacttcaatgcaattcgcaagttatggaaaatcccccgaggagctcccttagaatccttttggcaaggatacttggttcacggcacaagagaagaagtagagcatgctattggtctttctgagccttatgtacgtctgcttattgtgaacgattcaaggagtgccttgattgctggaaaaccagacgcctgtcaggcagtaatcagtagactaaactccaagttcccttctctgccggtaaagcaaggaatgattggtcattgcccagaagttcgtgcgttcatcaaagatattgggtacatccatgaaacactccgaatttccaatgactattcggattgtcagcttttctcagcggtaaccaagggcgcacttgacagctccacaatggaaatcaaacactttgtgggagaggtctactcccggatcgcagactttcctcaaatcgtcaacacggtgcattcggctggttatgacgtatttcttgagcttggctgtgatgcttctagatctgcagcagttcaaaacattcttggtggtcaaggaaagttcttgtctacagctattgacaaaaaaggacactccgcctggtcacaagtacttcgggctaccgcatcattagctgcacatcgagtaccgggaatctcaattttggatttgtttcacccaaatttccgagaaatgtgctgtacaatggcaaccacacctaaagtggaagataagttcctgcgcacgattcaaatcaatggtcggtttgaaaaagaaatgattcacctagaagatacaacattaagttgcttacccgctccaagtgaagcaaatatcgcagctattcaatctcggtcaattcgatctgctgcggcgcgttctggacaatcccatgattgtgcatcccatagccatgaagaaaataaggattcatgccctgaaaagctgaagcttgattctgtgtccgtcgccataaatttcgacaatgatgaccgcattcagcttgggcacgcgggttttcgggagatgtac

SEQ ID NO: 58 - protein, 500 aa, Thraustochytrium sp.
MLTGKDWVSPSGSCFAPNPLSSAKVAFMYGEGRSPYCGVGLGLHRLWPGLHENVNNKTVDLWTEGDGWLYPRTLTREEHTKAIESFNANQIEMFRAGIFISMCQTDYVMNVLGVQPKAGFGLSLGEISMLFAMSKENCRQSQEMTNRLRGSPVWSNELAINFNAIRKLWKIPRGAPLESFWQGYLVHGTREEVEHAIGLSEPYVRLLIVNDSRSALIAGKPDACQAVISRLNSKFPSLPVKQGMIGHCPEVRAFIKDIGYIHETLRISNDYSDCQLFSAVTKGALDSSTMEIKHFVGEVYSRIADFPQIVNTVHSAGYDVFLELGCDASRSAAVQNILGGQGKFLSTAIDKKGHSAWSQVLRATASLAAHRVPGISILDLFHPNFREMCCTMATTPKVEDKFLRTIQINGRFEKEMIHLEDTTLSCLPAPSEANIAAIQSRSIRSAAARSGQSHDCASHSHEENKDSCPEKLKLDSVSVAINFDNDDRIQLGHAGFREMY

SEQ ID NO: 59 - DNA, 1305 bp, Thraustochytrium sp.
  CDS (1)..(1305)
aatacaagatatagcttgtacacaggggcgatggcaaagggaattgcatctgcagatcttgtcattgccgctgggaaagagggcatcctagcttcctatggagctggaggactacctcttgctactgttcgaaagggaatagacaaaattcaacaagccttgccaagtggcccatatgctgtaaatcttattcactctccctttgacggcaacttggagcagggaaacgtcgatttgttcttggaaaagaacgtccgcgtggcggaatgttccgcgtttacaacgctaacagtgccagtagtacactatcgtgctgcagggcttgttcggcgccaagatggaagcattttgatcaagaaccgaatcattgctaaagtatctaggacagaactcgctgagatgttccttcgtccggcacctcaaatcatcctcgaaaaactggtagcagcagaaatcatttcatctgaccaagcgcgtatggcagccaaagttcccatggcggacgacatcgcagtcgaagccgactctggtgggcacacggataatcggcctatgcacgtcattttgcccctgataattcaactccgcaatactatacttgcagagtatggctgtgccacggcttttcgtacccgtataggcgctggaggaggcattggttgtccttcagcggccctcgcagcctttgatatgggtgcgagttttgtcgtgactggaagcataaatcaaatttgccgcgaggcagggacttgcgatactgttcgggagctacttgccaactcaagctactcggacgtgacgatggcgccagcagcagacatgtttgaccaaggtgtgaaactccaagtcttaaaacgaggaacgatgtttccaagcagagcaaataaactccggaagctctttgtgaactacgaatctctagaaacactcccgtcgaaagagttgaaatacctggaaaacatcatattcaagcaagcagtagaccaggtgtgggaggaaacaaagcgcttttactgtgaaaaactgaacaatccagataaaattgcaagggccatgaaagatcctaaattgaagatgtcgctttgctttcggtggtatctctccaagagctctgggtgggccaacgcaggaattaaatctcgtgcactcgactaccagatctggtgtggcccggcaatgggctcgttcaacaatttcgccagcggcacatccctcgattggaaagtgactggggttttccctggcgttgcggaagtaaacatggccattttagatggcgcgcgagaactagctgctaaacgaaat

SEQ ID NO: 60 - protein, 435 aa, Thraustochytrium sp.
NTRYSLYTGAMAKGIASADLVIAAGKEGILASYGAGGLPLATVRKGIDKIQQALPSGPYAVNLIHSPFDGNLEQGNVDLFLEKNVRVAECSAFTTLTVPVVHYRAAGLVRRQDGSILIKNRIIAKVSRTELAEMFLRPAPQIILEKLVAAEIISSDQARMAAKVPMADDIAVEADSGGHTDNRPMHVILPLIIQLRNTILAEYGCATAFRTRIGAGGGIGCPSAALAAFDMGASFVVTGSINQICREAGTCDTVRELLANSSYSDVTMAPAADMFDQGVKLQVLKRGTMFPSRANKLRKLFVNYESLETLPSKELKYLENIIFKQAVDQVWEETKRFYCEKLNNPDKIARAMKDPKLKMSLCFRWYLSKSSGWANAGIKSRALDYQIWCGPAMGSFNNFASGTSLDWKVTGVFPGVAEVNMAILDGARELAAKRN

SEQ ID NO: 61 - DNA, 4410 bp, Thraustochytrium sp.
  CDS (1)..(4410)
atgggcccgcgagtggcgtcaggcaaggtgccggcttgggagatgagcaagtccgagctgtgtgatgaccgcacggtagtctttgactatgaggagctgctggagttcgctgagggcgatatcagtaaggtttttgggccggagttcaaagtggtggacgggtttaggcgcagggtgaggttgcccgctcgagagtacctgctggtgacccgggttacgctgatggatgccgaggtgggcaactttcgagtgggagcacgtatggtgacagagtatgacgtacctgtgaacggagagctctcggaagggggagatgtgccgtgggctgtgttggtggaagccgggcagtgcgacttgctgctaatttcttacatgggcatcgatttccagtgcaaaggagagcgggtctaccggctgctgaacaccaccttgacgttttttggcgtcgcgaaagaaggggaaacgcttgtgtacgatattcgcgtcacgggtttcgccaagaggccggacggagatatctccatgttctttttcgaatatgattgctactgcaatggcaagcttctcatcgaaatgcgagatggctctgcaggcttcttcacggacgaagagctcgctgccggcaaaggagtggtcgtcactcgtgcacagcaaaacatgcgggacaaaattgtacggcagtccattgagccttttgcactggcggcttgcacgcacaaaacgactctgaacgagagtgacatgcagtcccttgtggagcgaaactgggcaaacgtttttggcaccagtaacaagatggcggagctcaactataaaatttgcgccaggaaaatgctcatgatcgacagggttacccacattgaccaccacggtggggcgtatggcctcggactacttgttggagagaagatcttggatcgaaaccattggtactttccttgtcactttgtcaatgatcaagtcatggcagggtcactggtcagcgatggttgcagccagctcttaaaactctatatgatctggcttggcctccacctgaaaatggaggaatttgattttctcccagttagcggccacaaaaacaaggtgcgatgcaggggacaaatttcaccgcataaaggcaagcttgtctacgtcatggaaatcaaaaagatgggttacgatcaagcatctggaagcccatacgccatcgcggacgttgatatcattgacgtcaacgaagagctgggtcaaagttttgacatcaacgaccttgcgagctacggaaaaggtgacctgagcaaaaaaatcgtggttgacttcaaaggaattgctttgcagctcaaaggccgcgctttttcacgcatgagttccagctcgtccttgaacgaaggatggcaatgtgttccaaaaccaagccagagaatggaacacgaacagccccctgctcactgccttgcaagcgaccccgaagccccttcaactgtgacctggcacccaatgtcaaagcttcctggcaaccctacgccgttcttctccccttcatcttaccctccgagggcaatttgcttcatccctttcccgggcaatccccttgacaacaactgcaaggctggagaaatgcccctgaactggtacaacatgtcagagttcatgtgtggcaaggtttctaactgcttgggcccagaattcgcacgctttgacaagtcgaacaccagccggagccctgcttttgacttggctctggtgacccgagttgttgaagtcacaaacatggaacacggcaagtttctaaacgttgattgcaatccaagcaaaggcacaatggtgggggagtttgactgtccccaagacgcgtggttctttgatggttcgtgcaacgacggccatatgccgtattccattatcatggaaatcggactgcaaacctcaggtgttctcacctcggtgttgaaggcaccgctgactatggacaaggatgacattctctttcgaaacctcgatgcaagtgctgaaatggtgcgtccagacgtggatgttcgcggcaaaacgattcgaaacgtgaccaagtgtaccggctatgcaatgttgggaaagatggggattcaccggttcacgtttgagttgagcgttgacggcgtggtattttataaaggatccacttcctttggatggttcactcccgaggtgtttgctcagcaagctggactcgacaacgggaaaaagacggagccctggtgcaagactaacaacacctcggttcgaagagttgaaatcgcatccgccaaaggaaaagagcagctgactgagaagcttcccgacgcaactaatgctcaagttcttcggcgttcagagcagtgtgaatacctcgattacctcaatattgcccctgactctgggctgcatgggaagggctacgcccacggacacaaagacgttaacccgcaagactggttcttctcttgccacttttggttcgatcctgtaatgccaggatctttaggaattgaatcaatgttccagcttatcgaggcctttgcggtggaccaaaacattcctggagagtacaacgtatccaatccgacctttgcccatgcaccaggcaaaacggcgtggaaataccgaggccagctcacaccaaagaaccgtgcgatggactgcgaggtgcatatcgtttcaattaccgcctcccccgagaacgggggctacgttgacatcgtggccgatggagcgctttgggtagatggacttcgcgtgtacgaagccaaagagcttcgagttcgtgtcgtttcggcaaaacctcaagcaattccggatgtacaacaacagccacctagcgcaaaggcggacccggggaaaacaggagttgcactttcgcccactcagctacgcgacgtcctgcttgaagtggacaatccattgtatcttggtgtagagaactccaatttggtgcagtttgagtcgaaacctgcaacttcttcacgtatcgtttcgatcaaaccgtgctcgattagtgaccttggcgataagtcttttatggaaacgtacaacgtgtcagcacctctgtatactggagcaatggccaagggcattgcatccgccgacttggtcattgctgctgggaaacgcaagatacttggatcgtttggtgcgggagggctgcctatttccatagtccgtgaagcactggagaaaattcaacaacacctgccccacggcccctacgctgttaacctcattcactcgcctttcgacagcaacttggaaaagggcaacgttgacctctttctcgagatgggcgtgacagtggtagaatgcagcgcgttcatggaactcacggcccaggttgtccggtaccgcgcgtctggtctaagcaaaagtgcggacggttcgattcgcattgctcaccgtattattggcaaggtttccagaaccgagctggcagaaatgtttattcgtccagcaccacagcacctcctccaaaaactcgtagcctccggcgagctgacagctgagcaagccgagcttgcaacacaggttccggtggcggatgacattgcggtcgaagccgactcgggggggcataccgacaacaggcctattcacgtcattcttcctctaatcatcaacctacgcaaccgtttgcataaagagcttgactacccttcgcatctccgggtacgtgtgggtgctggtggtggtattggatgtcctcaagccgctcttgcagcatttcaaatgggggcagcgtttttaatcactggaacggtgaaccagcttgctcgtgaaagtggcacttgtgacaacgtccggttacagctctcaaaggccacgtatagcgacgtgtgtatggctcctgctgccgatatgtttgaccaaggcgtggagctgcaagtattgaagaaaggcacgctgttcccaagtcgtgctaagaagctgtacgagctgttctgcaagtatgactcgtttgaggcaatgccggctgaagaattgcaacgggttgaaaagcggatttttcaaaagtcgcttgctgaagtttggcaggagaccagtgacttttacattcatcgtatcaagaaccctgagaaaatcaatcgtgctgcaagcgatggcaaactgaaaatgtcgctttgctttcgctggtaccttgggctttcctcattttgggccaactctggggcacaagatcgcgtcatggactatcaaatttggtgtggccctgctattggcgctttcaatgattttaccaagggcacgtaccttgacgtgactgttgcaaagagttacccttgtgtggcacagatcaatttgcaaattttgcaaggagctgcgtatctgaaacgccttggtgtcattcgttttgaccgcatgctgctgcaggccgtcgatatcgacgatcctgtatttacttacgtgccgacccagccactt

SEQ ID NO: 62 - protein, 1470 aa, Thraustochytrium sp.
MGPRVASGKVPAWEMSKSELCDDRTVVFDYEELLEFAEGDISKVFGPEFKVVDGFRRRVRLPAREYLLVTRVTLMDAEVGNFRVGARMVTEYDVPVNGELSEGGDVPWAVLVEAGQCDLLLISYMGIDFQCKGERVYRLLNTTLTFFGVAKEGETLVYDIRVTGFAKRPDGDISMFFFEYDCYCNGKLLIEMRDGSAGFFTDEELAAGKGVVVTRAQQNMRDKIVRQSIEPFALAACTHKTTLNESDMQSLVERNWANVFGTSNKMAELNYKICARKMLMIDRVTHIDHHGGAYGLGLLVGEKILDRNHWYFPCHFVNDQVMAGSLVSDGCSQLLKLYMIWLGLHLKMEEFDFLPVSGHKNKVRCRGQISPHKGKLVYVMEIKKMGYDQASGSPYAIADVDIIDVNEELGQSFDINDLASYGKGDLSKKIVVDFKGIALQLKGRAFSRMSSSSSLNEGWQCVPKPSQRMEHEQPPAHCLASDPEAPSTVTWHPMSKLPGNPTPFFSPSSYPPRAICFIPFPGNPLDNNCKAGEMPLNWYNMSEFMCGKVSNCLGPEFARFDKSNTSRSPAFDLALVTRVVEVTNMEHGKFLNVDCNPSKGTMVGEFDCPQDAWFFDGSCNDGHMPYSIIMEIGLQTSGVLTSVLKAPLTMDKDDILFRNLDASAEMVRPDVDVRGKTIRNVTKCTGYAMLGKMGIHRFTFELSVDGVVFYKGSTSFGWFTPEVFAQQAGLDNGKKTEPWCKTNNTSVRRVEIASAKGKEQLTEKLPDATNAQVLRRSEQCEYLDYLNIAPDSGLHGKGYAHGHKDVNPQDWFFSCHFWFDPVMPGSLGIESMFQLIEAFAVDQNIPGEYNVSNPTFAHAPGKTAWKYRGQLTPKNRAMDCEVHIVSITASPENGGYVDIVADGALWVDGLRVYEAKELRVRVVSAKPQAIPDVQQQPPSAKADPGKTGVALSPTQLRDVLLEVDNPLYLGVENSNLVQFESKPATSSRIVSIKPCSISDLGDKSFMETYNVSAPLYTGAMAKGIASADLVIAAGKRKILGSFGAGGLPISIVREALEKIQQHLPHGPYAVNLIHSPFDSNLEKGNVDLFLEMGVTVVECSAFMELTAQVVRYRASGLSKSADGSIRIAHRIIGKVSRTELAEMFIRPAPQHLLQKLVASGELTAEQAELATQVPVADDIAVEADSGGHTDNRPIHVILPLIINLRNRLHKELDYPSHLRVRVGAGGGIGCPQAALAAFQMGAAFLITGTVNQLARESGTCDNVRLQLSKATYSDVCMAPAADMFDQGVELQVLKKGTLFPSRAKKLYELFCKYDSFEAMPAEELQRVEKRIFQKSLAEVWQETSDFYIHRIKNPEKINRAASDGKLKMSLCFRWYLGLSSFWANSGAQDRVMDYQIWCGPAIGAFNDFTKGTYLDVTVAKSYPCVAQINLQILQGAAYLKRLGVIRFDRMLLQAVDIDDPVFTYVPTQPL

SEQ ID NO: 63 - DNA, 1500 bp, Thraustochytrium sp.
  CDS (1)..(1500)
atgggcccgcgagtggcgtcaggcaaggtgccggcttgggagatgagcaagtccgagctgtgtgatgaccgcacggtagtctttgactatgaggagctgctggagttcgctgagggcgatatcagtaaggtttttgggccggagttcaaagtggtggacgggtttaggcgcagggtgaggttgcccgctcgagagtacctgctggtgacccgggttacgctgatggatgccgaggtgggcaactttcgagtgggagcacgtatggtgacagagtatgacgtacctgtgaacggagagctctcggaagggggagatgtgccgtgggctgtgttggtggaagccgggcagtgcgacttgctgctaatttcttacatgggcatcgatttccagtgcaaaggagagcgggtctaccggctgctgaacaccaccttgacgttttttggcgtcgcgaaagaaggggaaacgcttgtgtacgatattcgcgtcacgggtttcgccaagaggccggacggagatatctccatgttctttttcgaatatgattgctactgcaatggcaagcttctcatcgaaatgcgagatggctctgcaggcttcttcacggacgaagagctcgctgccggcaaaggagtggtcgtcactcgtgcacagcaaaacatgcgggacaaaattgtacggcagtccattgagccttttgcactggcggcttgcacgcacaaaacgactctgaacgagagtgacatgcagtcccttgtggagcgaaactgggcaaacgtttttggcaccagtaacaagatggcggagctcaactataaaatttgcgccaggaaaatgctcatgatcgacagggttacccacattgaccaccacggtggggcgtatggcctcggactacttgttggagagaagatcttggatcgaaaccattggtactttccttgtcactttgtcaatgatcaagtcatggcagggtcactggtcagcgatggttgcagccagctcttaaaactctatatgatctggcttggcctccacctgaaaatggaggaatttgattttctcccagttagcggccacaaaaacaaggtgcgatgcaggggacaaatttcaccgcataaaggcaagcttgtctacgtcatggaaatcaaaaagatgggttacgatcaagcatctggaagcccatacgccatcgcggacgttgatatcattgacgtcaacgaagagctgggtcaaagttttgacatcaacgaccttgcgagctacggaaaaggtgacctgagcaaaaaaatcgtggttgacttcaaaggaattgctttgcagctcaaaggccgcgctttttcacgcatgagttccagctcgtccttgaacgaaggatggcaatgtgttccaaaaccaagccagagaatggaacacgaacagccccctgctcactgccttgcaagcgaccccgaagccccttcaactgtgacctggcacccaatgtcaaagcttcctggcaac

SEQ ID NO: 64 - protein, 500 aa, Thraustochytrium sp.
MGPRVASGKVPAWEMSKSELCDDRTVVFDYEELLEFAEGDISKVFGPEFKVVDGFRRRVRLPAREYLLVTRVTLMDAEVGNFRVGARMVTEYDVPVNGELSEGGDVPWAVLVEAGQCDLLLISYMGIDFQCKGERVYRLLNTTLTFFGVAKEGETLVYDIRVTGFAKRPDGDISMFFFEYDCYCNGKLLIEMRDGSAGFFTDEELAAGKGVVVTRAQQNMRDKIVRQSIEPFALAACTHKTTLNESDMQSLVERNWANVFGTSNKMAELNYKICARKMLMIDRVTHIDHHGGAYGLGLLVGEKILDRNHWYFPCHFVNDQVMAGSLVSDGCSQLLKLYMIWLGLHLKMEEFDFLPVSGHKNKVRCRGQISPHKGKLVYVMEIKKMGYDQASGSPYAIADVDIIDVNEELGQSFDINDLASYGKGDLSKKIVVDFKGIALQLKGRAFSRMSSSSSLNEGWQCVPKPSQRMEHEQPPAHCLASDPEAPSTVTWHPMSKLPGN

SEQ ID NO: 65 - DNA, 1500 bp, Thraustochytrium sp.
  CDS (1)..(1500)
cctacgccgttcttctccccttcatcttaccctccgagggcaatttgcttcatccctttcccgggcaatccccttgacaacaactgcaaggctggagaaatgcccctgaactggtacaacatgtcagagttcatgtgtggcaaggtttctaactgcttgggcccagaattcgcacgctttgacaagtcgaacaccagccggagccctgcttttgacttggctctggtgacccgagttgttgaagtcacaaacatggaacacggcaagtttctaaacgttgattgcaatccaagcaaaggcacaatggtgggggagtttgactgtccccaagacgcgtggttctttgatggttcgtgcaacgacggccatatgccgtattccattatcatggaaatcggactgcaaacctcaggtgttctcacctcggtgttgaaggcaccgctgactatggacaaggatgacattctctttcgaaacctcgatgcaagtgctgaaatggtgcgtccagacgtggatgttcgcggcaaaacgattcgaaacgtgaccaagtgtaccggctatgcaatgttgggaaagatggggattcaccggttcacgtttgagttgagcgttgacggcgtggtattttataaaggatccacttcctttggatggttcactcccgaggtgtttgctcagcaagctggactcgacaacgggaaaaagacggagccctggtgcaagactaacaacacctcggttcgaagagttgaaatcgcatccgccaaaggaaaagagcagctgactgagaagcttcccgacgcaactaatgctcaagttcttcggcgttcagagcagtgtgaatacctcgattacctcaatattgcccctgactctgggctgcatgggaagggctacgcccacggacacaaagacgttaacccgcaagactggttcttctcttgccacttttggttcgatcctgtaatgccaggatctttaggaattgaatcaatgttccagcttatcgaggcctttgcggtggaccaaaacattcctggagagtacaacgtatccaatccgacctttgcccatgcaccaggcaaaacggcgtggaaataccgaggccagctcacaccaaagaaccgtgcgatggactgcgaggtgcatatcgtttcaattaccgcctcccccgagaacgggggctacgttgacatcgtggccgatggagcgctttgggtagatggacttcgcgtgtacgaagccaaagagcttcgagttcgtgtcgtttcggcaaaacctcaagcaattccggatgtacaacaacagccacctagcgcaaaggcggacccggggaaaacaggagttgcactttcgcccactcagctacgcgacgtcctgcttgaagtggacaatccattgtatcttggtgtagagaactccaatttggtgcagtttgagtcgaaacctgcaacttcttcacgtatcgtttcgatcaaaccgtgctcgattagtgacctt

SEQ ID NO: 66 - protein, 500 aa, Thraustochytrium sp.
PTPFFSPSSYPPRAICFIPFPGNPLDNNCKAGEMPLNWYNMSEFMCGKVSNCLGPEFARFDKSNTSRSPAFDLALVTRVVEVTNMEHGKFLNVDCNPSKGTMVGEFDCPQDAWFFDGSCNDGHMPYSIIMEIGLQTSGVLTSVLKAPLTMDKDDILFRNLDASAEMVRPDVDVRGKTIRNVTKCTGYAMLGKMGIHRFTFELSVDGVVFYKGSTSFGWFTPEVFAQQAGLDNGKKTEPWCKTNNTSVRRVEIASAKGKEQLTEKLPDATNAQVLRRSEQCEYLDYLNIAPDSGLHGKGYAHGHKDVNPQDWFFSCHFWFDPVMPGSLGIESMFQLIEAFAVDQNIPGEYNVSNPTFAHAPGKTAWKYRGQLTPKNRAMDCEVHIVSITASPENGGYVDIVADGALWVDGLRVYEAKELRVRVVSAKPQAIPDVQQQPPSAKADPGKTGVALSPTQLRDVLLEVDNPLYLGVENSNLVQFESKPATSSRIVSIKPCSISDL

SEQ ID NO: 67 - DNA, 1410 bp, Thraustochytrium sp.
  CDS (1)..(1410)
ggcgataagtcttttatggaaacgtacaacgtgtcagcacctctgtatactggagcaatggccaagggcattgcatccgccgacttggtcattgctgctgggaaacgcaagatacttggatcgtttggtgcgggagggctgcctatttccatagtccgtgaagcactggagaaaattcaacaacacctgccccacggcccctacgctgttaacctcattcactcgcctttcgacagcaacttggaaaagggcaacgttgacctctttctcgagatgggcgtgacagtggtagaatgcagcgcgttcatggaactcacggcccaggttgtccggtaccgcgcgtctggtctaagcaaaagtgcggacggttcgattcgcattgctcaccgtattattggcaaggtttccagaaccgagctggcagaaatgtttattcgtccagcaccacagcacctcctccaaaaactcgtagcctccggcgagctgacagctgagcaagccgagcttgcaacacaggttccggtggcggatgacattgcggtcgaagccgactcgggggggcataccgacaacaggcctattcacgtcattcttcctctaatcatcaacctacgcaaccgtttgcataaagagcttgactacccttcgcatctccgggtacgtgtgggtgctggtggtggtattggatgtcctcaagccgctcttgcagcatttcaaatgggggcagcgtttttaatcactggaacggtgaaccagcttgctcgtgaaagtggcacttgtgacaacgtccggttacagctctcaaaggccacgtatagcgacgtgtgtatggctcctgctgccgatatgtttgaccaaggcgtggagctgcaagtattgaagaaaggcacgctgttcccaagtcgtgctaagaagctgtacgagctgttctgcaagtatgactcgtttgaggcaatgccggctgaagaattgcaacgggttgaaaagcggatttttcaaaagtcgcttgctgaagtttggcaggagaccagtgacttttacattcatcgtatcaagaaccctgagaaaatcaatcgtgctgcaagcgatggcaaactgaaaatgtcgctttgctttcgctggtaccttgggctttcctcattttgggccaactctggggcacaagatcgcgtcatggactatcaaatttggtgtggccctgctattggcgctttcaatgattttaccaagggcacgtaccttgacgtgactgttgcaaagagttacccttgtgtggcacagatcaatttgcaaattttgcaaggagctgcgtatctgaaacgccttggtgtcattcgttttgaccgcatgctgctgcaggccgtcgatatcgacgatcctgtatttacttacgtgccgacccagccactt

SEQ ID NO: 68 - protein, 470 aa, Thraustochytrium sp.
GDKSFMETYNVSAPLYTGAMAKGIASADLVIAAGKRKILGSFGAGGLPISIVREALEKIQQHLPHGPYAVNLIHSPFDSNLEKGNVDLFLEMGVTVVECSAFMELTAQVVRYRASGLSKSADGSIRIAHRIIGKVSRTELAEMFIRPAPQHLLQKLVASGELTAEQAELATQVPVADDIAVEADSGGHTDNRPIHVILPLIINLRNRLHKELDYPSHLRVRVGAGGGIGCPQAALAAFQMGAAFLITGTVNQLARESGTCDNVRLQLSKATYSDVCMAPAADMFDQGVELQVLKKGTLFPSRAKKLYELFCKYDSFEAMPAEELQRVEKRIFQKSLAEVWQETSDFYIHRIKNPEKINRAASDGKLKMSLCFRWYLGLSSFWANSGAQDRVMDYQIWCGPAIGAFNDFTKGTYLDVTVAKSYPCVAQINLQILQGAAYLKRLGVIRFDRMLLQAVDIDDPVFTYVPTQPL

SEQ ID NO: 69 - DNA, 6180 bp, Artificial
  synthetic
atggccgctcgcaacgtgagcgccgcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgcacgggccacgactccatttctgcgctctcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcgtgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtcacgatctcgccgctgtaccactccaagcttgtggcggaggctgaggcttgctacgctgcgctctgcaagggtgaaaagcccaagaagaacaagtttgtgcgcaagattcagctcaacggtcgcttcaacagcaaggcggaccccatctcctcggccgatcttgccagctttccgcctgcggaccctgccattgaagccgccatctcgagccgcatcatgaagccggttgctccgaagttctacgcgcgtctcaacattgacgagcaggacgagacccgtgatccgatcctcaacaaggacaacgcgccgtcttccagctctagctcctcttccagctcttccagctcttccagcccgtcgccagctccgtccgccccagtgcaaaagaaggctgctccggccgcggagaccaaggctgttgcttcggctgacgcacttcgcagtgccctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctgtaa

SEQ ID NO: 70 - DNA, 8394 bp, Artificial
  synthetic
  misc_feature (227)..(227)
  misc_feature (227)..(227): n is a, c, g, or t
ccgcgaatcaagaaggtaggcgcgctgcgaggcgcggcggcggagcggagcgagggagagggagagggagagagagggagggagacgtcgccgcggcggggcctggcctggcctggtttggcttggtcagcgcggccttgtccgagcgtgcagctggagttgggtggattcatttggattttcttttgtttttgtttttctctctttcccggaaagtgttggccggncggtgttctttgttttgatttcttcaaaagttttggtggttggttctctctcttggctctctgtcaggcggtccggtccacgccccggcctctcctctcctctcctctcctctcctctccgtgcgtatacgtacgtacgtttgtatacgtacatacatcccgcccgccgtgccggcgagggtttgctcagcctggagcaatgcgatgcgatgcgatgcgatgcgacgcgacgcgacgcgagtcactggttcgcgctgtggctgtggcttgcttgcttacttgctttcgagctctcccgctttcttctttccttctcacgccaccaccaacgaaagaagatcggccccggcacgccgctgagaagggctggcggcgatgacggcacgcgcgcccgctgccacgttggcgctcgctgctgctgctgctgctgctgctgctgctgctgctgctgctgctgctgcttctgcgcgcaggctttgccacgaggccggcgtgctggccgctgccgcttccagtccgcgtggagagatcgaatgagagataaactggatggattcatcgagggatgaatgaacgatggttggatgcctttttcctttttcaggtccacagcgggaagcaggagcgcgtgaatctgccgccatccgcatacgtctgcatcgcatcgcatcgcatgcacgcatcgctcgccgggagccacagacgggcgacagggcggccagccagccaggcagccagccaggcaggcaccagagggccagagagcgcgcctcacgcacgcgccgcagtgcgcgcatcgctcgcagtgcagaccttgattccccgcgcggatctccgcgagcccgaaacgaagagcgccgtacgggcccatcctagcgtcgcctcgcaccgcatcgcatcgcatcgcgttccctagagagtagtactcgacgaaggcaccatttccgcgctcctcttcggcgcgatcgaggcccccggcgccgcgacgatcgcggcggccgcggcgctggcggcggccctggcgctcgcgctggcggccgccgcgggcgtctggccctggcgcgcgcgggcgccgcaggaggagcggcagcggctgctcgccgccagagaaggagcgcgccgggcccggggagggacggggaggagaaggagaaggcgcgcaaggcggccccgaaagagaagaccctggacttgaacgcgaagaagaagaagaaggagaagaagttgaagaagaagaagaagaaggagaggaagttgaagaagacgaggagcaggcgcgttccaaggcgcgttctcttccggaggcgcgttccagctgcggcggcggggcgggctgcggggcgggcgcgggcgcgggtgcgggcagaggggacgcgcgcgcggaggcggagggggccgagcgggagcccctgctgctgcggggcgcccgggccgcaggtgtggcgcgcgcgacgacggaggcgacgacgccagcggccgcgacgacaaggccggcggcgtcggcgggcggaaggccccgcgcggagcaggggcgggagcaggacaaggcgcaggagcaggagcagggccgggagcgggagcgggagcgggcggcggagcccgaggcagaacccaatcgagatccagagcgagcagaggccggccgcgagcccgagcccgcgccgcagatcactagtaccgctgcggaatcacagcagcagcagcagcagcagcagcagcagcagcagcagcagcagccacgagagggagataaagaaaaagcggcagagacgatgggtccccgtgttgcttccggtaaggttccggcctgggagatgtcgaagtcggagctctgcgatgaccgcacggtcgtgtttgattacgaggagctccttgagttcgccgagggtgacatctccaaggtgttcggtccggagtttaaagtcgttgacggctttcgtcgccgcgtccgcctccccgcgcgtgagtacctccttgtcacccgcgtcacgcttatggacgccgaggtgggtaactttcgcgtgggcgctcgcatggttactgagtacgacgttccggtcaacggcgagctgtctgagggcggcgacgtgccctgggccgttcttgtcgaggccggccagtgcgacctcctcctcatctcgtacatgggcatcgacttccagtgcaagggagagcgcgtctaccgcctcctcaacaccacccttacgttcttcggcgtcgccaaggagggcgagactctcgtgtacgacatccgcgtcactggtttcgccaagcgccctgacggcgacatctcgatgttcttctttgagtacgactgctactgcaacggtaagctcctcatcgagatgcgcgatggttctgccggctttttcactgatgaggagctcgctgccggcaagggcgtcgtcgtcacgcgtgcccagcaaaacatgcgcgacaagatcgtccgtcagtccatcgagccgtttgcgctcgccgcctgcactcacaagacgaccctcaacgagtccgacatgcagtccctcgtcgagcgcaactgggcgaacgtgttcggcaccagcaacaagatggccgagctcaactacaagatttgcgcccgcaagatgctcatgatcgaccgcgtgacccacatcgaccatcatggcggcgcttacggcctcggcctccttgtcggcgaaaagatcctcgatcgtaaccattggtacttcccctgccactttgtgaatgaccaagttatggccggctcccttgtctctgacggctgttcgcagctgcttaagctttacatgatctggctcggcctccacctcaagatggaggagttcgattttctccccgtcagcggccacaagaacaaggtccgctgccgcggacagatttcgccccacaagggtaagctcgtctacgtgatggagattaagaagatgggctacgaccaggcttcgggcagcccctacgccattgcggacgttgatatcattgatgtcaacgaggagctcggccagtcgtttgacatcaacgatctcgcgtcgtacggtaagggcgacctctcgaagaagattgttgtcgatttcaaaggtatcgctctccagctgaaaggccgcgccttctcccgcatgtcctcctcgtcctccctcaacgagggctggcagtgcgtgcccaagccgtcgcagcgcatggagcacgagcaaccccctgcccattgcctcgcctccgatccggaggcccctagcacggtgacgtggcaccccatgagcaagctccccggcaaccccacccccttcttttctccctcgtcgtatccgccccgtgctatctgcttcatcccttttccgggcaacccgctcgacaacaactgcaaggccggcgagatgcccctcaactggtacaacatgagcgaattcatgtgcggtaaggtcagcaactgcctcggcccggagttcgcccgctttgacaagagcaacacctcccgctcccccgccttcgaccttgcgctcgtcacgcgcgtcgtcgaggtcaccaacatggagcacggcaagttcctcaacgtcgactgtaacccttcgaagggcacgatggtgggagagttcgactgcccgcaggacgcctggttctttgacggctcctgcaatgacggtcatatgccgtactccatcatcatggagatcggccttcagacgtctggtgtcctcacgtcggtgctcaaggctcctctcacgatggacaaggacgacatcctctttcgcaaccttgatgcctcggctgagatggtgcgccctgacgtcgatgtccgcggcaagaccatccgcaacgtgaccaagtgtaccggctacgccatgcttggtaagatgggtatccatcgctttacctttgagctctccgtggacggcgtcgtcttttacaagggcagcaccagcttcggctggtttacgccggaagtgtttgcccagcaggccggtctggacaacggcaagaagaccgagccctggtgcaagaccaacaacacctccgtccgccgcgtcgagatcgccagcgctaagggtaaggagcagctcacggagaagctccctgatgctaccaacgcccaggttctccgccgctccgagcagtgcgagtacctcgactacctcaacatcgcccccgactccggccttcacggcaagggttacgcgcacggccacaaggacgtcaacccccaggactggtttttctcgtgccacttctggttcgacccggtgatgcccggctcgcttggcattgagtccatgttccagctcatcgaagcctttgctgtcgaccagaatatccctggcgagtacaatgtttcgaacccgacctttgcccatgcccccggtaagaccgcttggaagtatcgcggccagctcactcccaagaaccgcgctatggactgcgaggtccacatcgtcagcatcacggcgagcccggagaacggcggctacgtcgacatcgtcgccgacggcgccctttgggtcgatggcctccgcgtttacgaggccaaggagctccgtgtccgcgtcgtcagcgccaagccgcaagctatcccggatgtccagcagcagcctccctcggctaaggccgaccctggcaagaccggtgtcgccctcagccccacccagctccgcgatgtcctcctggaggtcgacaaccctctgtacctcggtgtcgagaactccaaccttgtccagttcgaaagcaagccggcgacgtcctcccgcatcgtgtccattaagccgtgttctatctccgacctcggcgacaagtctttcatggagacttacaacgtgtctgcgcctctttacaccggcgcgatggccaagggtattgccagcgctgacctcgtcatcgccgctggcaagcgtaagatcctcggttcgttcggtgccggtggcctcccgatctccatcgttcgcgaggcccttgagaagatccagcagcacctcccccacggcccttacgccgtcaaccttatccactccccgttcgactcgaacctggagaagggcaatgtcgacctttttcttgaaatgggtgtcaccgtcgtcgagtgctcggctttcatggagctcacggctcaggtcgttcgctaccgcgcttccggcctctccaagagcgcggacggcagcatccgcatcgcgcaccgcatcatcggcaaggtgagccgcactgagcttgccgagatgttcatccgtcctgcccctcagcaccttctccagaagctggtcgccagcggcgagctcaccgccgaacaggccgagcttgccacgcaagtcccggtcgccgatgacatcgcggtcgaggccgattcgggcggtcacaccgacaaccgcccgatccacgtgattctcccccttattatcaacctccgcaaccgccttcacaaggagctcgactacccctcgcacctgcgcgtgcgcgtgggagccggcggtggtatcggctgccctcaggcggccctggcggcctttcagatgggcgctgctttcctgattaccggcaccgtcaaccagctcgcccgtgagtcgggcacctgcgacaacgtccgccttcagctctccaaggccacctacagcgacgtgtgcatggcccctgccgcggacatgtttgaccagggcgtggagcttcaggtgctcaagaagggcacgctgttccccagccgcgccaagaagctctacgagctcttctgcaagtacgactccttcgaggccatgccggccgaggagcttcagcgtgtcgagaagcgcatctttcagaagtcgctggccgaggtttggcaggagacttcggatttctacattcaccgcattaagaaccctgagaagatcaatcgcgctgccagcgacggtaaactcaagatgtcgctttgcttccgctggtatcttggcctctcgtcgttctgggccaactccggtgcccaggaccgcgtcatggactaccagatttggtgcggtcccgcgatcggagccttcaacgattttaccaagggcacctacctcgacgtcacggttgccaagtcttacccgtgcgttgcccagatcaacctccaaatccttcagggtgcggcttacctcaagcgcctcggtgtgatccgcttcgaccgcatgctcctccaggcggtcgacatcgatgacccggttttcacgtacgtccccacccagcccctctaagaaagtgaaccttgtcctaacccgacagcgaatggcgggagggggcgggctaaaagatcgtattacatagtatttttcccctactctttgtgtttgtctttttttttttttgaacgcattcaagccacttgtctbggtttacttgtttgttygcttgcttgcttgcttgcttgcctgcttcttggtcagacggcccaaaaaagggaaaaaattcattcatggcacagataagaaaaagaaaargtttgtcgaccaccgtcatcagaaagcaagagaagagaaacactcgcgctcacattctcgctcgcgtaagaatcttagccacgcatacgaagtaatttgtccatctggcgaatctttacatgagcgttttcaagctggagcgtgagatcatacctttcttgatcgtaatgttccaaccttgcataggcctcgttgcgatccgctagcaatgcgtcgtactcccgttgcarctgcgccatcgcctcattgtgacgtgagttcagattcttctcgagaccttcgagcgctgctaatttcgcctgacgctccttcttttgtgcttccatgacacgccgcttcaccgtgcgttccacttcttcctcagacatgcccttggctgcctcgacctgctcggtaagcttcgtcgtaatctcctcgatctcggaattcttcttgccctccatccactcggcaccatacttggcagcctgttcaacacgctcattgaaaaacttttcattctcttccagctccgcaacccgcgctcgaagctcattcacttccgccaccacggcttcggcatcgagcgccgaatcagtcgccgaactttccgaaagatacaccacggcccctccgctgctgctgcgcagcgtcatcatcagtcgcgtgttatcktcgcgcagattctccacctgctccgtaagcagcttcacggtggcctcttgattctgagggctcacgtcgtggattagcgcttgcagctcttgcagctccgtcagcttggaagagctcgtaatcatggctttgcacttgtccagacgtcgcagagcgttcgagagccgcttcgcgttatctgccatggacgcttctgcgctcgcggcctccctgacgacagtctcttgcagtttcactagatcatgtccaatcagcttgcggtgcagctctccaatcacgttctgcatcttgtttgtgtgtccgggccgcgcctcgtcttgcgatttgcgaatttcctcctcgagctcgcgttcgagctccarggcgcctttaagtagctcgaagtcagccgccgttagccccagctccgtcgccgcgttcagacagtcggttagcttgattcgattccgcttttccatggcaagtttaagatcctggcccagctgcacctcctgcgccttgcgcatcatgcgcggttccgcctggcgcaaaagcttcgagtcgtatcctgcctgccatgccagcgcaatggcacgcacgagcgacttgagttgccmactattcatcgccgagatgagcagcattttgatctgcatgaacacctcgtcagagtcgtcatcctctgcctcctccagctctgcgggcgagcgacgctctccttgcagatgaagcgagggccgcaggcctccgaagagcacctcttgcgcgagatcctcctccgtcgtcgccctccgcaggatygcggycgtgtccgccatcttgccgccacagcagcttttgstcgctctgcaccttcaatttctggtgccgctggtgccgctggtgccgcttgtgctggtgctggtgctggtgctggtgctggtgccttgtgctggtgctgccacagacaccgccgctcctgctgctgctcttccggccccctcgccgccgccgcgagcccccgccgcgcgccgtgcctgggctctccgcgctctccgcgggctcctcggcctcggcctcgccgtccgcgacgacgtctgcgcggccgatggtgcggatctgctcta

SEQ ID NO: 71 - DNA, 12495 bp, Artificial
  synthetic
cgactgcgagggctcttgcgtcatccgcctgatgcggccgccggccggaagaggccgccccgcagcctccccggtgcggggccgcgccgggatgcctcgcctgcgtccccagcgatgcgaggcggcgacgtctgtgctgccgtcaggtcctgtgcgaggtcccactgttaatattaagtacgtaccgcacaggacccggagtagcgcggcgcggggacgacctccgacgcggccggaagacggcgcccacagcacgcgctcgggttcgcgggcggcggccgcgcgaagtgcgtaagcagacggcgcgcggtccggctgcgggggaagaaggtgtggaaggtgcggggggaacccgtggccgcctacgtgtgcctgcgacggaggcgcggcggcgcccggcacctaggaactgtctaagagggcttacaacggacagcccgtcacaggcgcagaggcggcggcggcgggtctttccttctctcccggcagaaagagagggagggagagagagagaaagcctgaatgtggctgcgatggagacttgggcagcgataatgacttggtgggctgaagattactctcagcattgctgcgcgcttagcattcttgcggcattggccaggtcggcgtcgggtttcgcttgcggcgacgaccgagggtcgttggatcgcgcggcagattagacaggcagctgggacgcacgcacgcacgcacgaacgaacaaacaaacgagagaacgtgcgtacgggcctgctggccgcggatgcagaaaagtgaatggaattttccactacagccagcgagccctgtcagccagctagctgcagcttgagcggagcggcggctgttgctgcgtctcttgaacttgaattcgaatggatgtatgtacttgcttgcctcttgatgctgcgttgacttgtggatgatgttcaaagtggcaggcacaccacctaaaatcaaaaaatgtaaaggcgcggcgcagaaccgtgcatctgccgaggagcgcgtgcaccgctgccgtgcgtgcggtgcgtgcgtgctcgcctgcatccgcgtcgccggcaaggtctctgtgctgtatctatcgctcgcattcgaatcgctcgcgccttctgctccgacgtgccctaaaacatagagtccatcattaggctagtgatactctatgtgacttgcttccttcctggagaggaagaatgaataccgtatggtatcaggtatgaagaaaaccaacctcgcgcctccggacccaccgccgcgcggccagccagatccgcgcggccagctcgtccatgccagcctcgggaggtatccatcccctccgcgccggcagctgtcggtctctcgccatcgcctgtgccgctcgaagaagtttcagcaacctctccgtcctgcgccatggcaccatcttatcttctccgcgtcccactcttctctcccaaagcctgcacctcaaaggcgaggccgggccaggccgcagccgcgccacgagaagccccatcacgccgcctcgcacgcggccgcgcgcgtctgcgcgagacggcgctgttattttcttttcttttcttttcttttcttctctcctccccgctctcctcgcttcctgcgcgccgctgcgggggcgaaggaagacaggggggctcgggaggaagaggaggcgagggaaggaaggagggcggcgacggcatcgccagacgacgacggcggcggcgggggacgcggggcgcgcgtccccccgtgcgtggcagcatgatgcatgcgatgcgcgcgatgcgtgcggcgcgaggaggcgaggcccgatgggcggaggcgagcggggtggatacgggcggcggcgggcgggagcgggaggcaggcagaccccgaaccccgagggtaaaactacacaaacagacagacagcctgcggctgcctggcaacaagactcacgcacgcacgcacgcaccgatcggtcgagcgagcgagcgcttgatcgaacggacgtgagaaccagcaaggaagcagcagcagcagcagcagcagcaacagctcgagagagagaaaatgaaggatatggaggatcgccgcgtcgccattgtcggtatgtcggcccatctcccctgcggcaccgacgtgaaggagtcgtggcaggccattcgtgatggtatcgattgcctgtctgacctccccgccgaccgcctcgacgtcacggcgtactacaaccccaacaaggccactaaggataagatttactgcaagcgcggtggctttattcccaactacgattttgatcctcgcgagtttggccttaacatgttccagatggaggactccgacgccaaccagactctcactcttctgaaggtcaagcaggccctggaggacgcttccattgagccctttaccaaggagaagaagaacatcggctgcgtcctcggaatcggcggtggccagaaggccagccacgagttttactctcgcctcaactacgttgtcgtcgagaaggtcctccgcaagatgggcctccctgatgccgacgttgaggaggccgtggagaagtacaaggccaattttcctgagtggcgcctcgacagcttccctggcttcctcggcaacgtcactgctggccgctgctccaacacctttaacatggagggtatgaactgcgtggtggacgccgcctgcgcctcctccctcatcgccattaaggtggcggtggaggagctcctcttcggcgactgcgacaccatgattgccggtgccacctgcacggataactcgctcggcatgtacatggctttttccaagacgccggtgttcagcaccgacccctccgtccgcgcctacgatgaaaagactaagggcatgcttatcggcgagggctccgccatgttcgtgctcaagcgctacgccgacgcggtccgtgatggcgacactatccacgccgttctccgtagctgctcgtccagcagcgacggcaaggccgctggaatttacacgcctacgatctcgggccaggaggaggccctccgccgtgcctacgcccgcgctggcgtctgcccctcgaccatcggcctcgttgagggtcacggcaccggcacgccggtcggcgaccgcatcgagctcactgccctccgcaatctcttcgacaaggcttttggctccaagaaggaacaaatcgctgtcggttccatcaagtctcagatcggccacctcaagagcgtggccggctttgctggcctggtcaaggcggtcctggccctcaagcacaagacgctccctggctcgattaacgtggaccagcctcccctcctttacgacggcacgcagatccaggactcgtccctgtacattaacaagactaaccgcccctggtttacccaaaacaagctccctcgccgtgcgggtgtcagctccttcggttttggtggcgccaactaccacgccgtcctcgaagagtttgagcccgagcacgagaagccttaccgcctcaacacggtcggccaccccgtcctcctctacgcccccagcgtcgaggccctcaaggtcctttgcaacgaccagctcgccgaactcaccatcgcgcttgaggaggccaagacccacaagaacgtggacaaggtttgcggttacaagtttatcgacgagttccagctccagggtagctgccctcctgagaacccccgcgtcggctttctcgccactctcccgacgtccaacatcatcgtcgctctcaaggcgatcctcgctcagctcgatgccaagcctgacgccaagaagtgggacctcccgcacaagaaggctttcggtgctaccttcgcctcgtcgtcggtcaagggctcggttgccgcgctgttcgccggccagggcactcagtacctcaacatgttttccgatgtcgcgatgaactggccccctttccgcgattcgatcgtggccatggaggaggcccagaccgaggtgttcgagggccaggttgaacccatttcgaaggtcctctttccgcgcgagcgttacgcctcggagtcggagcagggcaacgagctgctctgcctcaccgagtactcgcagcccactacaattgccgccgctgtcggcgcctttgacatcttcaaggcggctggctttaagcccgatatggtcggaggccactcccttggcgagtttgctgccctgtacgccgctggctcgatctctcgcgatgacctctacaagctcgtctgcaagcgtgccaaggcgatggcgaacgcgagcgatggagccatggccgctgtgatcggtcccgatgctcgcctcgtcactcctcagaactccgacgtctacgtcgccaatttcaatagcgcgacgcaggtcgtcatcagcggcacggtgcagggcgtcaaagaggagagcaagctccttattagcaagggttttcgcgtcctgcctctgaagtgccagggcgccttccactccccgctcatgggaccttccgaggactccttcaagtcgctcgttgagacttgtactatctccccgcctaagaacgtcaagttcttttgcaacgtgagcggcaaggagtcgcctaatccgaagcagactctcaagtctcacatgaccagctccgtccagtttgaggagcagatccgcaacatgtacgatgccggtgcccgtgtctttctggagtttggccctcgccaggtgctcgccaagctcatcgccgagatgttcccctcgtgcaccgccatctcggtcaacccggcctcctcgggcgactcggacgtccagctccgcctcgcggccgtcaagtttgcggtgtccggcgctgccctctcgacgtttgacccctgggagtaccgcaagccccaggacctccttatccgcaagccccgcaagaccgcgctcgtcctctctgctgccacgtacgtttcgcctaagaccctcgccgagcgcaagaaggccatggaggacatcaagctcgtgtcgatcacccctcgcgactcgatggtttcgattggtaagatcgctcaagaggtccgcactgctaagcagcccctcgaaaccgagattcgccgcctcaacaaggagctcgaacacctcaagcgcgagctcgcggctgccaaagcttcggtcaagtctgcctccaagtcctctaaggagcgcagcgtcctctccaagcaccgcgccctcctccagaacatcctccaagactacgacgacctccgcgtcgtccccttcgccgtccgctcggtcgccgtggacaacaccgcgccgtacgccgaccaggtcagcacccctgcctcggagcgtagcgcgtcgccccttttcgagaagcgttcctccgtttcgtcggctcgcctggccgaggcggaggccgccgtcctctctgtgctcgccgacaagacgggctacgacagctcgatgatcgagatggacatggacctggagagcgagcttggcgtggactccatcaagcgcgtcgagatcatgtccgaggtccagactcttctctcggtcgaggtcagcgatgttgacgctctcagccgcaccaaaacggtcggcgacgtgatcgaggctatgaagctcgaacttggcggaccccaaggccagaccctcaccgccgagtcgatccgtcagcctcccgtgtcggagcccgccgtcccgacgtcctcctcttcctccatcgctaacgtctcttctgctcgcctcgccgaggctgaagctgctgttctttctgtcctcgccgacaagaccggctacgactcgtccatgattgagatggacatggacctcgaaagcgagctcggcgtcgacagcattaagcgcgtcgagatcatgtccgaggtgcagacccttctcagcgtggaggtttcggacgtcgatgccctctcccgcactaagaccgtcggcgatgtcatcgaggccatgaagctcgaactcggcggtcctcagggtcaaacgctgaccgccgagtcgattcgccagccccctgtttccgagccggccgtgccgacgtcgtcgtcgagctcgatcgccaacgtttccagcgcccgcctcgccgaggccgaagccgccgtcctctccgtcctcgcggacaagaccggttacgactcctcgatgattgaaatggacatggatcttgagtctgagcttggcgtcgattccatcaagcgcgttgagatcatgtcggaagtgcaaactctcctttctgttgaagtctctgatgtcgatgctctcagccgcacgaaaaccgtcggtgacgtcatcgaggccatgaagctcgaactcggtggccctcagggccagaccctcaccgccgagtccatccgtcaaccgcccgtgtccgagcccgccgtcccgacctcctcgtcgagctcgattgcgaacgttctctcggcgcgtctcgcggaggccgaggccgcggtcctctcggtcctcgccgacaagacgggctacgactccagcatgatcgagatggacatggacctcgaatctgagctcggcgtcgacagcattaagcgcgtcgagattatgagcgaggtccagaccctcctctccgtggaggtttcggacgtggacgcgctctcgcgtaccaagaccgttggcgacgttattgaggccatgaaactcgaactcggtggccctcagggacagaccctcactgccgagtcgattcgccagcctccggtttctgagcctgctgttcctacgtcctcttcttcttctattgctaatgtcagctcggcgcgcctcgcggaggccgaggctgccgtgctctcggttctcgcggacaagaccggctatgactcgtccatgattgagatggatatggatcttgagtccgagctgggcgtcgatagcatcaagcgtgtggaaatcatgtccgaagtccagaccctcctctcggtcgaggtcagcgatgtcgacgccctctcgcgcaccaagaccgtcggcgatgtcatcgaggccatgaaacttgagctcggcggacctcagggacagaccctcacgtccgagccgatccaccagccgcccgtgagcgagccggccgtcccgacttcgagctcctcgtccatcgccaatgtctctagcgctcgcctcgccgaggccgaggccgccgtgctgtccgtcctcgccgataagaccggatatgactccagcatgatcgagatggacatggaccttgagtccgagctgggtgttgattctattaagcgtgttgagattatgtcggaggtgcagacccttctctcggtcgaagtctctgatgtcgatgccctctctcgtaccaagactgtcggcgacgtcatcgaggctatgaagatggagctcggcggaccccagggccagactcttaccgccgaatctatccgccagccgcctgtcagcgagcctgccgtccctacctcctcgtcctcgtcgattgccaacgtttcttctgcccgtcttgccgaggccgaggcggccgtcctctcggtcctcgcggacaagaccggttatgattcgtcgatgattgagatggacatggaccttgagtcggagctcggagtcgacagcatcaagcgcgtcgagatcatgtcggaggtccaggctctcctctccgtcgaggttagcgatgtcgacgccctctcgcgcaccaagaccgttggcgatgttattgaggccatgaaaatggagctcggtggtccgcagggccagaccctcactgccgagtcgattcgcgagccgccggtttccgagccggccgtgcccacgagcagctcgtcgagcatcgctaacgtcagctcggcccgccttgccgaggccgaggctgctgtcctctccgtgctcgccgataagactggttatgactcgtccatgattgagatggacatggacctggagtccgagctcggcgtggactcgatcaagcgcgttgagatcatgtctgaggtgcagaccctgctttccgtcgaggtgagcgacgtcgatgccctgtcgcgtaccaagactgtgggtgacgtcatcgaggcgatgaagctggagctcggagagtcgagctcgattgagactcttaattgcaccgaggtcgagcacacgtcctacaagagcgtcaaggccagcggatgcgagaacgtggacacccgtttcgccaaagtggtccagatcagcctcccgtccaagcttaagagcaccgtcagccatgaccgcccggtcattgttgtggatgacggcaccccgcttaccacggagctctgcaagattctcggtggcaacattgtcgttctcagctaccagggcaagcctgccggccctcgtggcgtcgaggttcccgacctctcggaggaggccctcatccaggcgctcgccctcattcgctcgacctacggcgtccccattggtttcatctgccagcaggtttccaacgtcagcaccaaggcccagctctgctgggcgctgctggccgctaagcacctcaagaaggacctcaatgccgtcctccctgactcccgctcgtttttcgtgggcgttgtccgcctcaacggcaagctgggcacctttgagaacatttccgactttagcaagttcgatctcactaaggcgctcgactacggccagcgcggctccctcctcggcctgtgcaagagcctcgatcttgagtgggagcaggttttctgccgcggcatcgacctggcctgcgacctcatgcctctccaagccgcgcgtatcctccgcaacgagctccagtgcccgaacatgcgcctgcgcgaggtcggctacgatatctcgggcgctcgctacaccatctccaccgacgaccttctttgcggccctagcaaggccaaggtcgaagcggcggacctctttcttgtcacgggtggtgcccgcggtatcactccccactgcgtccgcgagatcgcctcgcgtagccccggcacgacgtttgttctcgtcggccgctccgagatgagcgacgagcccgactgggccgtgggtcactacaacaaggatctcgaccagtccacgatgaagcacctgaaggccacgcatgctgccggaggcgtgaagccgactcccaaggcgcaccgcgcccttgtcaaccgtgtcaccggctcgcgcgaggtccgcgagagcctgcgcgccattcaggaggcgggtgcgaacgttgagtacatcgcctgcgacgtcagcgacgagaacaaggtgcgccagctcgtccagcgcgtggagcagaagtacggttgcgagattacgggcatctggcacgcctcgggtgttctccgcgacaagctcgtggagcaaaagaccacggacgacttcgaggccgtgtttggcactaaggtcacgggcctcgtgaacatcgtcagccaggtcaacatgtccaagctgcgccatttcatcctcttctcctcgctcgcgggctttcacggcaacaagggccagaccgactacgccatcgccaacgaggccctcaacaagatcgcccacaccctttccgcctttctccccaagctcaacgcgaaggtcctcgactttggcccgtgggtcggctccggcatggtcacggagactcttgagaagcactttaaggccatgggcgtccagaccatccccctcgaaccgggtgcccgcaccgtggcccagatcatcctcgccagctctccgccccagtccctcctcggtaactggggcttccccgccacgaaaccccttcagcgctccaacgtggtcaccggcaccctctcgccggaggagatcgaatttatcgccgatcacaagatccagggccgcaaggttctcccgatgatggccgccatcggcttcatggcgtcgatcgccgagggcctctaccctggctacaaccttcagggcgttgagaacgctcagctttttcagggcctcaccatcaaccaggaaaccaagttccagatcacgctcatcgaggagcacaactccgaggagaacctcgacgtcctcaccagcctcggtgtcatgctcgaaagcggcaaggtgcttcccgcctaccgttgcgtcgtctgcctcaacactacccagcagcagcccaagctcagccccaagatcctcaacctggaggttgaccccgcctgcgaggtcaacccctacgacggcaagtccctctttcacggcccgctcctccaatttgtccagcaggtcctccactcgtcgacgaaaggcctcgtggcgaagtgccgtgccctgccgattaaggaggccatccgtggcccgttcatcaagcagacgctccacgacccgatcctcgacgacgtcatctttcagctcatgctcgtgtggtgccgcaacgccctcggctcggcctccctcccgaaccgcattgagaagatgagctacttcggtaatgtgtcggagggcagcactttcttcgccagcgttacccccgtcggcccccgtgtcccgaaggatcccgtgatcaagatgcagtttctcctccaggacgagtccggcaacaccttttcgtccggcgagggcagcgtcgtcctcagcgatgagctcgtgttctaaatctaaactagtgaatcgcgacaagttgtctttttgttactctacgtactgctctttctaattttacgacgtatgcttctgctcttgacgacgacaaccatggcaataaaagtaaggcaagaaagtgagtgcgtgctcgctcacaaggtctaggccgaaacgaggcgccttaggattggttgtctccgtcgtaagtcatgacggagcgtaggacaccgacggcctgccgcgcaaatatacgaaccgctgcacaattcttttcgttgagaacaacctcgaacggcctgccttgctgagctgccgacacggtggaaggaagcatagcggccaatcgaggggatgctattaattaggcttggcgctgctgccgccgtgcctgaagatgtgcgcaagcgtggcaacaccgtccaccttgccattaaagtcatgcactccaaatacctcgaacagagcctctcgcatgtttggccaagcaccttcgagagagtctggactctcactccttcctcaccgttgtcgccattctcagcgagctcatgcaatcaccaggacggagagacggccagctgcttttctgctttccattgttattagagaaacgcttctcgctctcatcgtcttagtagacattccgatggcttcgttcgccaatttgtcacctaagtaagctagagtgttaagtctaaatgcctttgacccgcgtacggcgtcacgtagatgcctgtccttgccagcaaacgctagttcgcggtgtgcgtaatttggcccgcattatgctggctctcaaaatcaaccgccaccactcgcggctgcacgatgattttcgtgcactcatgacatgagaaatgtgatactcaaactagtatagacctcctactcctactgctgcttttctcgtcagagctgtctccggaaaagttgacaagttgttggccttcttcttctctgctagtaagtagatcatcatggatgagacgatgatgataatgatgatgatgatagcgaagagcttttgggactcgagcttgagctgatgtggcttattttattactcaaaaaccaatgcaccgttgcgagctctcgagagtggagcaaagttgcaacagcgcacacacaaagaacacatagaaatagacatcaaaaatagtacttttacaatccagccgaggcagcgcgaaaagtcagcatctgcgaactgccacaaaagccgtagatcaagttttgacacaacgctcatgcacgtctacgtgctcgcgcatataggaaaacaaatcacatcgagagattcccactcaggtcgtgcgtggccttttgggcatactcttgccgcgcagcagcccacaacgcctcatcttctcccataccaaggtcaaaggatggttgtattttgtcgtgaagttggggcggcattttctctaaaagcattgatgcaatagatttcgggctgtagcgcgcggaaaaatgcatgagcagaagcgtatcgacgcgatcaaacaagcctcgatgaccgaacgctgcaagttggtcaacatgaatatggccgtggtcttcggccttggaaatgtcgccatcgaaaaaggtcacctccacgcagagcgtctttgcacggagaaagggagattcagggtcccgttccaaagcagcagcgaccgtgtcgcccgtgtaagcaaagtcgacaacctcgtgtatgacgtagtcctcaggctttggtggcgaggtcttgaagcgagtgcgctttgtcgcaacggggagctccgcaagttccggacgtaactcctttttgatattaatgaccgcatatcctacagaaggcacacgatgctcggttgcaaggactgcaacgcgcgtattcccgttcaactctacgctgtcgccggggttgacgcccgtgatcttcatattgaaggggtcctgggtgtcgtcaacatctcctcctccgtcgagggcttgcatcgctcgccctgcactgcgaaaatcctccacagcctccgcaggcatgtagacgcgcgtctcctt

SEQ ID NO: 72 - DNA, 8647 bp, Artificial
  synthetic
ctatactggtgctcttcggtgctgatttagctcgacttgggtccacaccactgcccctctactgtgaatggatcaatggacgcacgacgggccgacgaaagtgcgcgagtgaggtaacctaagcaacggcggtcttcagaggggacgcacgccctccgtcgcagtcagtccagacaggcagaaaagcgtcttagggaccacgcacgcacgcacgcacgcacgcacgcccgcacgcacgctccctccctcgcgtgcctatttttttaggcttccttccgcacgggcctacctctcgctccctcgcctcgccgcaccaggcggcagcagcgatacctgccggtgccgcctccgtcacgcgctcagccgcagctcagcccagccgcgagctagggtttgttcgtcctgaattgtttgatttgatttgatttgatttgatccgatccgatccgatctgatctgatttgctttgctttgctttgtctccctcccggcgcggaccaagcgtccgtctgcgcgccgcagcttcccttcttctcccagccctccttctgctcccgcctctcgcgcaagcacgcagcttcgccgccgcatccggtcggtcggtcggtcgatcgacccgcctgccgctgctgctgtggccgggcttttctccatcggcgactctttcttctccatacgtcctactacgtacatacatactgccggcttcctcctcttccagcgcggcgacggcggcaggctgcgacgtcgtcgccgccgcgggcgccgcgcgcgccgccgccgccgcccgcgtcgcagggcctcgtcgccgccgccgctccgctccgctccgaggccgcgagagggccgcggcggcgcgatggatggatggatggatggatggatggatggattttgttgatcgatggcggcgcatgggcggagatgagcgaggacgagcgcgcgagcgcggcagccggattcgcagggcctcgctcgcctcgcgcccgctgccgcgcccgccttgcgagcctgcgccgcgagcgagcgagcgagcgagcggggctttctttgtctcgcgcgccgcttggcctcgtgtgtcttgtgcttgcgtagcgggcgccgcggtggaagatggctcattcaatcgacccattcacgcacgcactccggcgcgcagagaaggccgaggaggagcagcaagcaaaccaaaagctctcgcgctcgcggtctcgggctcgagcggtctcggagagagagtcttgcggcgaccaccggcagcagcagcagcagcagcagcgctgtcgagcacgagcacgagcacgagcacgagcacgagcattcgagcaagaggacagacacggttgtcagcgcctagctcgctcgatacagaaagaggcgggttgggcgtaaaaaaaaaggagcacgcaagccgccagccagccagctagctagccagcctgcctgccaaaatgcagctcccgcccgctcactccgctgatgagaaccgcattgccgtggtcggcatggccgtgaagtacgctggctgcgacaacaaggaggaattctggaaaaccctcatgaacggttcgattaacaccaaaagcattagcgcggctcgccttggctcgaacaagcgcgacgagcactacgtcccggagcgcagcaagtacgccgacacgttctgcaacgagcgttacggctgcatccagcagggcacggataacgagcacgacctcctcctcggcctcgcccaggaggccctcgccgatgctgccggccgtatggagaagcagccgtcggaggccttcgatcttgagaataccggcatcgtgtcgggctgcctgagctttccgatggataacctccagggcgagctcctcaacctctaccagtcccacgtcgagaagcagcttcccccgtctgctctcgtggaggccgtcaagctctggagcgagcgccagaagtccactaaggcccacgcgggcgacaagcgccgctttatcgatccggcgtctttcgtcgccgacaagctgaacctcggccccctccactacgccatcgacgccgcctgcgcctcggcgctctacgtgctgaagctcgcccaggaccacctcgtcagcggcgctgtcgatatgatgctctgcggcgccacttgtttcccggagccgttcttcatcctctcgggcttcagcaccttccaagccatgccggtcggtgcggacggcgtgtcgctccccctccacaagacctcggctggcctcacccccggtgagggcggctccatcatggttctcaagcgcctcaaggacgccatccgcgacggcaaccacatctacggcgtgctccttgaggccaacctctcgaacgccggatgcggcctcccgctctcgccgcacctcccttccgaggagtcgtgcattcgcgacacctatcgccgcgctggcgtcgctgccgaccagagcatccagtacatcgagtgccacgccaccggcaccccgcgtggcgacgtcgtcgagatcgaggctgtcgagcgcgtctttaagaagaatgtgccccgccttggttctaccaagggcaacttcggccactccctcgtcgctgccggcttcgcgggtatggcgaagctgctcctcgctatggagcacggcgtcatcccgcccacccctggcctggacgccagcaatcaggcttccgagcacgtcgtcactaaggcgattacctggccggaaacccacggcgctcctaagcgcgccggcctctccgccttcggctttggcggcacgaacgcgcatgccctttttgaggagttcaatgccgagggcatttcctaccgccccggtaagcctccggtcgagtcgaacacccgcccctctgtggtcatcactggcatggactgcacgtttggcagcctggagggaatcgacgcctttgagactgccctctacgagggccgtgatgccgcccgtgatcttcctgccaagcgttggcgcttcctcggcgaggatctggagtttctccgcgccatccgcctgaaggagaagccccgtggctgctttgttgagtccgttgacgtgaactttcgccgcctcaagacccctctcaccccggaggatatgctccgcccgcagcagctcctcgctgtctccactatggaccgcgcgatcatcgacgccggcctcaagaagggccagcatgtcgccgtcctcgtcggcctcggcaccgatctggagctttaccgccaccgtgcccgtgtggccctcaaggaggtgctccacccctcgctgaagagcgacaccgccatcctccagaagatcatgcagtacgtcaacgacgcgggcacctcgacctcctacacctcgtacatcggcaacctcgtcgccacccgtatcagctcgcagtggggctttaccggcccgagctttactgtcacggagggtaacaacagcgtctaccgttgcgcccagctcgctaaggacatgctgcaagtcaaccgcgtcgatgccgtcgtcattgccggtgtggacctgaacggctccgccgagagcttcttcgtccgcgctaaccgtcaaaagatcagcaagctttcccacccgtgcgccagcttcgaccgcgacgccgacggcttctttgccggcgaaggctgcggcgctctcgtgttcaagcgccttgaggactgcgcccctcaggagaagatttacgcttccatcgacagcatcgccatcgacaaggagcctacctcctcggccgtcaaggctgtctaccagtccgactcctccctctccgacatcgagcttcttgagatcagcggcgactccaagcgttttgcggccttcgagggcgctgtcgagatccagtcctctgtggaggcgcagctcaagggcctttccaaggttcttgagcccgccaagggccaaggcgtcgccgttggctcgacccgcgccactgtcggtgatatcggctacgccactggcgcggcttcgctcatcaagacggccctgtgcctctacaaccgttacctgcctgccctcgccaactggagcggcccctgcgaacagagcgcctggggtagcaacatgttcgtctgccacgagactcgtccttggatgaagaaccagaacgagaagcgctgcgcgctcatctcgggcacggacccgtcccacacctgcttcagcctcgtgctctccgatactggttgctacgaggagcacaaccgcacgtgctttgacgtgcaggccccgcagctcgttctcattcatggttttgatggcaagaccattgtgcgccgccttgagggctatctccttgagcttgtcgagggccatgcctcgccgtccgagtactttcacaagctcatcggccagagcctccttgagaactccaaggagtcgaagctcacgctctcgctcgtctgcaaccccaaccaactccagaaggagctcatgctcgccatcaagggtgtgcagcgctctatgctgacgggtaaggactgggtttccccctcgggctcttgctttgctccgaaccctctctcgtccgccaaggtcgctttcatgtacggcgaaggccgctccccctactgcggtgtgggccttggcctccaccgcctctggcctggcctccacgaaaacgtgaacaacaagacggtggacctctggacggagggcgacggttggctctacccgcgcaccctcactcgtgaggagcacactaaggccatcgagtcgtttaacgctaaccagatcgagatgttccgtgccggtatctttatctccatgtgccagacggactacgtgatgaacgtcctcggcgtgcagcccaaggccggctttggcctctcgctcggcgagatcagcatgctcttcgccatgtccaaggagaactgccgccagagccaggagatgaccaaccgccttcgtggcagccccgtctggtcgaacgagcttgccattaacttcaatgcgatccgtaagctctggaagattccccgcggtgccccgcttgagtccttctggcagggctacctcgtccacggcacccgcgaggaggtcgagcacgccatcggcctcagcgagccctacgtccgcctgcttatcgtgaatgacagccgctcggcccttatcgcgggtaagcctgacgcctgccaggccgtgatctcgcgcctcaactcgaagttcccttctctccctgtgaagcagggcatgatcggccactgcccggaggtgcgcgccttcatcaaggacattggttacatccacgagactctccgtatctctaacgattactcggactgccagctcttttcggccgtcaccaagggtgcccttgactcgtctactatggagatcaagcacttcgtcggtgaggtctacagccgcattgccgattttccccagattgtcaacacggtgcactcggccggctacgacgtgtttctcgaactcggctgcgacgcctcccgcagcgccgctgttcagaacatcctcggcggtcagggcaagtttctgtctactgccattgacaagaagggtcactctgcctggtcgcaggttctccgcgctaccgcctcgctcgctgcccaccgcgtgcccggcatctcgatcctcgatctctttcacccgaatttccgcgagatgtgctgcacgatggctacgacccccaaggtggaggacaagtttctccgcaccatccagattaacggccgtttcgagaaggagatgatccacctcgaagataccactctctcctgccttcccgcgccttcggaggccaacattgccgccattcagtcgcgctcgattcgcagcgctgcggcccgtagcggccagtcgcacgactgcgcgtcccacagccatgaggagaataaggactcctgcccggagaagctcaaacttgactcggtcagcgtcgcgatcaactttgacaacgacgaccgtattcagctcggccacgcgggttttcgcgagatgtacaacacccgctactcgctctacacgggcgctatggctaaaggcatcgcttcggccgacctcgtcatcgctgcgggcaaggagggtatcctcgccagctacggtgctggcggcctcccgctcgccaccgtccgcaagggtatcgacaagatccagcaggcgctccccagcggtccttacgccgtcaacctcatccactccccgtttgacggcaacctggagcagggcaacgtcgacctctttctcgaaaagaacgtccgcgtcgccgagtgttctgcctttacgaccctcaccgtgcccgtcgtccattatcgcgccgctggcctcgttcgccgccaggacggctcgatcctcattaagaaccgcatcatcgccaaggtcagccgcaccgagctcgctgagatgttcctccgccctgcgccgcagattatcctcgaaaagctggtcgccgccgagatcatctccagcgatcaggcgcgtatggccgcgaaggtgccgatggccgacgacatcgccgtcgaggccgacagcggcggccacacggacaaccgcccgatgcatgttattctccccctcattatccagctccgcaacaccattctcgcggagtacggctgcgctactgcctttcgcacgcgtattggcgctggtggcggcatcggttgcccgagcgccgctctcgccgccttcgacatgggtgcctctttcgtcgtcaccggctccatcaatcagatttgccgcgaggcgggcacctgcgacacggttcgcgagctcctcgccaactcgtcgtacagcgatgtcacgatggctcctgccgccgacatgttcgatcagggcgtgaagctccaagtcctcaagcgcggcaccatgttcccctcgcgcgctaacaagcttcgcaagctctttgtgaactacgagtccctcgaaactctcccctccaaggagctcaagtaccttgagaacattattttcaagcaggctgtggaccaggtgtgggaggagactaagcgcttctactgcgagaagctgaacaaccccgacaagatcgctcgcgctatgaaggaccccaagctcaagatgtcgctctgcttccgctggtatctcagcaagtcgtcgggctgggccaacgccggcatcaagtctcgcgccctcgactaccaaatctggtgcggacccgcgatgggcagctttaacaacttcgcctccggcacgagcctcgactggaaagtgaccggtgtctttcccggcgtcgccgaggtgaacatggccatcctcgatggcgcccgcgagctcgctgccaagcgcaactaagtaagctctcatatatgttagttgcgtgagaccgacacgaagataatatcacatacgcttttgtttgttctttcaattatttgtctgtgcttcatgttgctcctcagtatctagctggcggctcttatcttcttttaaaatatctggacaaggacaaaaacaagaataaaggcgagaagatgtgaatttcatttcgacttgagaactcgaagagcattgatgcggttagtatatgggtattttccagacacttttcatcatcatcatcatcatcatcattatgaagaagtagtagctgataaagtagactcactgtttgcagcgagaaccaggccctttcggtccgtaaccttggtgaaaaatcgaggagcgatcatgccttgtgcgtcgccggggctaagaatgaccccgttgtctgattcgaaaaatttgatgccagcctcggcagctgcagcagcagcgtctacatacacgaagtacgtcacaaggacttgcgcatcccgctgatcacacccgtctccgaggacggaagcccgtgagcaaagtgaatgtgattccgtttcattcgcgacaaacccttgtcctggatctgagcccaggcagaagtatttgttccgtgcaagcacgtctcaatgcttgctggatcgagtggacgcaacaaactcgtctctttgacaactgacatggagtgtccctgattcgcacgaatcaaccagcttccgtccgtgtcctggcgcaacgtgaaccgctgcttgtcgttgtctcgcacgacagcctcaatgtccgaaaaggagatccccttgaagcgcttgagcttgccctgtagctcagccagacgaacaaatccatcttcgcgcacttcgagaccctcctgaacggccgagtgccgcagcacacggcttagcatgtgcgaaagcttcttgttatgcgccttggcttttgaaggcagcgttggcgcgctgcgagagtgtttacttggttgcgcagcttcactatcacgagcagcacttcgtttattcatttccatgttgtttgcaggttcagtggtagccccatccggcacgggccagagcaccctgtgagagcgccgttcctcgaccctgaggaaaagctccgtaggtatggctcctgtatcgcccagaccaggggtaagtaggacgccattgcttgattggaacatttccaagcccgcatcatgtgcgcgcgcggtatcgaggaagatgagcacctctgcggagccgcgaaagccactgagcactccgtcctgaccaggaagtcccgaggcaaaatgaatgtgatttcggcccatgcggcggaggccctggcgttggattgcaggccagtggcgaagatacgttccgtgaatacacagcggaagcaatgagaga

SEQ ID NO: 73 - DNA, 4479 bp, Artificial
  synthetic
  CDS (1)..(4479)
atggcgctccgtgtcaagacgaacaagaagccatgctgggagatgaccaaggaggagctgaccagcggcaagaccgaggtgttcaactatgaggaactcctcgagttcgcagagggcgacatcgccaaggtcttcggacccgagttcgccgtcatcgacaagtacccgcgccgcgtgcgcctgcccgcccgcgagtacctgctcgtgacccgcgtcaccctcatggacgccgaggtcaacaactaccgcgtcggcgcccgcatggtcaccgagtacgatctccccgtcaacggagagctctccgagggcggagactgcccctgggccgtcctggtcgagagtggccagtgcgatctcatgctcatctcctacatgggcattgacttccagaaccagggcgaccgcgtctaccgcctgctcaacaccacgctcaccttttacggcgtggcccacgagggcgagaccctcgagtacgacattcgcgtcaccggcttcgccaagcgtctcgacggcggcatctccatgttcttcttcgagtacgactgctacgtcaacggccgcctcctcatcgagatgcgcgatggctgcgccggcttcttcaccaacgaggagctcgacgccggcaagggcgtcgtcttcacccgcggcgacctcgccgcccgcgccaagatcccaaagcaggacgtctccccctacgccgtcgccccctgcctccacaagaccaagctcaacgaaaaggagatgcagaccctcgtcgacaaggactgggcatccgtctttggctccaagaacggcatgccggaaatcaactacaaactctgcgcgcgtaagatgctcatgattgaccgcgtcaccagcattgaccacaagggcggtgtctacggcctcggtcagctcgtcggtgaaaagatcctcgagcgcgaccactggtactttccctgccactttgtcaaggatcaggtcatggccggatccctcgtctccgacggctgcagccagatgctcaagatgtacatgatctggctcggcctccacctcaccaccggaccctttgacttccgcccggtcaacggccaccccaacaaggtccgctgccgcggccaaatctccccgcacaagggcaagctcgtctacgtcatggagatcaaggagatgggcttcgacgaggacaacgacccgtacgccattgccgacgtcaacatcattgatgtcgacttcgaaaagggccaggactttagcctcgaccgcatcagcgactacggcaagggcgacctcaacaagaagatcgtcgtcgactttaagggcatcgctctcaagatgcagaagcgctccaccaacaagaacccctccaaggttcagcccgtctttgccaacggcgccgccactgtcggccccgaggcctccaaggcttcctccggcgccagcgccagcgccagcgccgccccggccaagcctgccttcagcgccgatgttcttgcgcccaagcccgttgcccttcccgagcacatcctcaagggcgacgccctcgcccccaaggagatgtcctggcaccccatgtcaaagcttcctggcaaccctacgccgttcttctccccttcatcttaccctccgagggcaatttgcttcatccctttcccgggcaatccccttgacaacaactgcaaggctggagaaatgcccctgaactggtacaacatgtcagagttcatgtgtggcaaggtttctaactgcttgggcccagaattcgcacgctttgacaagtcgaacaccagccggagccctgcttttgacttggctctggtgacccgagttgttgaagtcacaaacatggaacacggcaagtttctaaacgttgattgcaatccaagcaaaggcacaatggtgggggagtttgactgtccccaagacgcgtggttctttgatggttcgtgcaacgacggccatatgccgtattccattatcatggaaatcggactgcaaacctcaggtgttctcacctcggtgttgaaggcaccgctgactatggacaaggatgacattctctttcgaaacctcgatgcaagtgctgaaatggtgcgtccagacgtggatgttcgcggcaaaacgattcgaaacgtgaccaagtgtaccggctatgcaatgttgggaaagatggggattcaccggttcacgtttgagttgagcgttgacggcgtggtattttataaaggatccacttcctttggatggttcactcccgaggtgtttgctcagcaagctggactcgacaacgggaaaaagacggagccctggtgcaagactaacaacacctcggttcgaagagttgaaatcgcatccgccaaaggaaaagagcagctgactgagaagcttcccgacgcaactaatgctcaagttcttcggcgttcagagcagtgtgaatacctcgattacctcaatattgcccctgactctgggctgcatgggaagggctacgcccacggacacaaagacgttaacccgcaagactggttcttctcttgccacttttggttcgatcctgtaatgccaggatctttaggaattgaatcaatgttccagcttatcgaggcctttgcggtggaccaaaacattcctggagagtacaacgtatccaatccgacctttgcccatgcaccaggcaaaacggcgtggaaataccgaggccagctcacaccaaagaaccgtgcgatggactgcgaggtgcatatcgtttcaattaccgcctcccccgagaacgggggctacgttgacatcgtggccgatggagcgctttgggtagatggacttcgcgtgtacgaagccaaagagcttcgagttcgtgtcgtttcggcaaaacctcaagcaattccggatgtacaacaacagccacctagcgcaaaggcggacccggggaaaacaggagttgcactttcgcccactcagctacgcgacgtcctgcttgaagtggacaatccattgtatcttggtgtagagaactccaatttggtgcagtttgagtcgaaacctgcaacttcttcacgtatcgtttcgatcaaaccgtgctcgattagtgaccttggcgataagtcttttatggaaacgtacaacgtgtcagcacctctgtatactggcgccatggccaagggcattgcctcggcggacctcgtcatcgccgccggcaagcgcaagatcctcggctcctttggcgccggcggcctccccatgcaccacgtgcgcgccgccctcgagaagatccaggccgccctgcctcagggcccctacgccgtcaacctcatccactcgccttttgacagcaacctcgagaagggcaacgtcgatctcttcctcgagaagggcgtcactgtggtggaggcctcggcattcatgaccctcaccccgcaggtcgtgcgctaccgcgccgccggcctctcgcgcaacgccgacggttcggtcaacatccgcaaccgcatcatcggcaaggtctcgcgcaccgagctcgccgagatgttcatccgcccggccccggagcacctcctcgagaagctcatcgcctcgggcgagatcacccaggagcaggccgagctcgcgcgccgcgttcccgtcgccgacgatatcgctgtcgaggctgactcgggcggccacaccgacaaccgccccatccacgtcatcctcccgctcatcatcaacctccgcaaccgcctgcaccgcgagtgcggctaccccgcgcacctccgcgtccgcgttggcgccggaggtggcgtcggctgcccgcaggccgccgccgccgcgctcaccatgggcgccgccttcatcgtcaccggcactgtcaaccaggtcgccaagcagtccggcacctgcgacaacgtgcgcaagcagctctcgcaggccacctactcggatatctgcatggccccggccgccgacatgttcgaggagggcgtcaagctccaggtcctcaagaagggaaccatgttcccctcgcgcgccaacaagctctacgagctcttttgcaagtacgactccttcgactccatgcctcctgccgagctcgagcgcatcgagaagcgtatcttcaagcgcgcactccaggaggtctgggaggagaccaaggacttttacattaacggtctcaagaacccggagaagatccagcgcgccgagcacgaccccaagctcaagatgtcgctctgcttccgctggtaccttggtcttgccagccgctgggccaacatgggcgccccggaccgcgtcatggactaccaggtctggtgtggcccggccattggcgccttcaacgacttcatcaagggcacctacctcgaccccgctgtctccaacgagtacccctgtgtcgtccagatcaacctgcaaatcctccgtggtgcctgctacctgcgccgtctcaacgccctgcgcaacgacccgcgcattgacctcgagaccgaggatgctgcctttgtctacgagcccaccaacgcgctc

SEQ ID NO: 74 - protein, 1493 aa, Artificial
  Synthetic Construct
MALRVKTNKKPCWEMTKEELTSGKTEVFNYEELLEFAEGDIAKVFGPEFAVIDKYPRRVRLPAREYLLVTRVTLMDAEVNNYRVGARMVTEYDLPVNGELSEGGDCPWAVLVESGQCDLMLISYMGIDFQNQGDRVYRLLNTTLTFYGVAHEGETLEYDIRVTGFAKRLDGGISMFFFEYDCYVNGRLLIEMRDGCAGFFTNEELDAGKGVVFTRGDLAARAKIPKQDVSPYAVAPCLHKTKLNEKEMQTLVDKDWASVFGSKNGMPEINYKLCARKMLMIDRVTSIDHKGGVYGLGQLVGEKILERDHWYFPCHFVKDQVMAGSLVSDGCSQMLKMYMIWLGLHLTTGPFDFRPVNGHPNKVRCRGQISPHKGKLVYVMEIKEMGFDEDNDPYAIADVNIIDVDFEKGQDFSLDRISDYGKGDLNKKIVVDFKGIALKMQKRSTNKNPSKVQPVFANGAATVGPEASKASSGASASASAAPAKPAFSADVLAPKPVALPEHILKGDALAPKEMSWHPMSKLPGNPTPFFSPSSYPPRAICFIPFPGNPLDNNCKAGEMPLNWYNMSEFMCGKVSNCLGPEFARFDKSNTSRSPAFDLALVTRVVEVTNMEHGKFLNVDCNPSKGTMVGEFDCPQDAWFFDGSCNDGHMPYSIIMEIGLQTSGVLTSVLKAPLTMDKDDILFRNLDASAEMVRPDVDVRGKTIRNVTKCTGYAMLGKMGIHRFTFELSVDGVVFYKGSTSFGWFTPEVFAQQAGLDNGKKTEPWCKTNNTSVRRVEIASAKGKEQLTEKLPDATNAQVLRRSEQCEYLDYLNIAPDSGLHGKGYAHGHKDVNPQDWFFSCHFWFDPVMPGSLGIESMFQLIEAFAVDQNIPGEYNVSNPTFAHAPGKTAWKYRGQLTPKNRAMDCEVHIVSITASPENGGYVDIVADGALWVDGLRVYEAKELRVRVVSAKPQAIPDVQQQPPSAKADPGKTGVALSPTQLRDVLLEVDNPLYLGVENSNLVQFESKPATSSRIVSIKPCSISDLGDKSFMETYNVSAPLYTGAMAKGIASADLVIAAGKRKILGSFGAGGLPMHHVRAALEKIQAALPQGPYAVNLIHSPFDSNLEKGNVDLFLEKGVTVVEASAFMTLTPQVVRYRAAGLSRNADGSVNIRNRIIGKVSRTELAEMFIRPAPEHLLEKLIASGEITQEQAELARRVPVADDIAVEADSGGHTDNRPIHVILPLIINLRNRLHRECGYPAHLRVRVGAGGGVGCPQAAAAALTMGAAFIVTGTVNQVAKQSGTCDNVRKQLSQATYSDICMAPAADMFEEGVKLQVLKKGTMFPSRANKLYELFCKYDSFDSMPPAELERIEKRIFKRALQEVWEETKDFYINGLKNPEKIQRAEHDPKLKMSLCFRWYLGLASRWANMGAPDRVMDYQVWCGPAIGAFNDFIKGTYLDPAVSNEYPCVVQINLQILRGACYLRRLNALRNDPRIDLETEDAAFVYEPTNAL

SEQ ID NO: 75 - DNA, 4479 bp, artificial
  synthetic
atggcgctccgtgtcaagacgaacaagaagccatgctgggagatgaccaaggaggagctgaccagcggcaagaccgaggtgttcaactatgaggaactcctcgagttcgcagagggcgacatcgccaaggtcttcggacccgagttcgccgtcatcgacaagtacccgcgccgcgtgcgcctgcccgcccgcgagtacctgctcgtgacccgcgtcaccctcatggacgccgaggtcaacaactaccgcgtcggcgcccgcatggtcaccgagtacgatctccccgtcaacggagagctctccgagggcggagactgcccctgggccgtcctggtcgagagtggccagtgcgatctcatgctcatctcctacatgggcattgacttccagaaccagggcgaccgcgtctaccgcctgctcaacaccacgctcaccttttacggcgtggcccacgagggcgagaccctcgagtacgacattcgcgtcaccggcttcgccaagcgtctcgacggcggcatctccatgttcttcttcgagtacgactgctacgtcaacggccgcctcctcatcgagatgcgcgatggctgcgccggcttcttcaccaacgaggagctcgacgccggcaagggcgtcgtcttcacccgcggcgacctcgccgcccgcgccaagatcccaaagcaggacgtctccccctacgccgtcgccccctgcctccacaagaccaagctcaacgaaaaggagatgcagaccctcgtcgacaaggactgggcatccgtctttggctccaagaacggcatgccggaaatcaactacaaactctgcgcgcgtaagatgctcatgattgaccgcgtcaccagcattgaccacaagggcggtgtctacggcctcggtcagctcgtcggtgaaaagatcctcgagcgcgaccactggtactttccctgccactttgtcaaggatcaggtcatggccggatccctcgtctccgacggctgcagccagatgctcaagatgtacatgatctggctcggcctccacctcaccaccggaccctttgacttccgcccggtcaacggccaccccaacaaggtccgctgccgcggccaaatctccccgcacaagggcaagctcgtctacgtcatggagatcaaggagatgggcttcgacgaggacaacgacccgtacgccattgccgacgtcaacatcattgatgtcgacttcgaaaagggccaggactttagcctcgaccgcatcagcgactacggcaagggcgacctcaacaagaagatcgtcgtcgactttaagggcatcgctctcaagatgcagaagcgctccaccaacaagaacccctccaaggttcagcccgtctttgccaacggcgccgccactgtcggccccgaggcctccaaggcttcctccggcgccagcgccagcgccagcgccgccccggccaagcctgccttcagcgccgatgttcttgcgcccaagcccgttgcccttcccgagcacatcctcaagggcgacgccctcgcccccaaggagatgtcctggcaccccatgagcaagctccccggcaaccccacccccttcttttctccctcgtcgtatccgccccgtgctatctgcttcatcccttttccgggcaacccgctcgacaacaactgcaaggccggcgagatgcccctcaactggtacaacatgagcgaattcatgtgcggtaaggtcagcaactgcctcggcccggagttcgcccgctttgacaagagcaacacctcccgctcccccgccttcgaccttgcgctcgtcacgcgcgtcgtcgaggtcaccaacatggagcacggcaagttcctcaacgtcgactgtaacccttcgaagggcacgatggtgggagagttcgactgcccgcaggacgcctggttctttgacggctcctgcaatgacggtcatatgccgtactccatcatcatggagatcggccttcagacgtctggtgtcctcacgtcggtgctcaaggctcctctcacgatggacaaggacgacatcctctttcgcaaccttgatgcctcggctgagatggtgcgccctgacgtcgatgtccgcggcaagaccatccgcaacgtgaccaagtgtaccggctacgccatgcttggtaagatgggtatccatcgctttacctttgagctctccgtggacggcgtcgtcttttacaagggcagcaccagcttcggctggtttacgccggaagtgtttgcccagcaggccggtctggacaacggcaagaagaccgagccctggtgcaagaccaacaacacctccgtccgccgcgtcgagatcgccagcgctaagggtaaggagcagctcacggagaagctccctgatgctaccaacgcccaggttctccgccgctccgagcagtgcgagtacctcgactacctcaacatcgcccccgactccggccttcacggcaagggttacgcgcacggccacaaggacgtcaacccccaggactggtttttctcgtgccacttctggttcgacccggtgatgcccggctcgcttggcattgagtccatgttccagctcatcgaagcctttgctgtcgaccagaatatccctggcgagtacaatgtttcgaacccgacctttgcccatgcccccggtaagaccgcttggaagtatcgcggccagctcactcccaagaaccgcgctatggactgcgaggtccacatcgtcagcatcacggcgagcccggagaacggcggctacgtcgacatcgtcgccgacggcgccctttgggtcgatggcctccgcgtttacgaggccaaggagctccgtgtccgcgtcgtcagcgccaagccgcaagctatcccggatgtccagcagcagcctccctcggctaaggccgaccctggcaagaccggtgtcgccctcagccccacccagctccgcgatgtcctcctggaggtcgacaaccctctgtacctcggtgtcgagaactccaaccttgtccagttcgaaagcaagccggcgacgtcctcccgcatcgtgtccattaagccgtgttctatctccgacctcggcgacaagtctttcatggagacttacaacgtgtctgcgcctctgtatactggcgccatggccaagggcattgcctcggcggacctcgtcatcgccgccggcaagcgcaagatcctcggctcctttggcgccggcggcctccccatgcaccacgtgcgcgccgccctcgagaagatccaggccgccctgcctcagggcccctacgccgtcaacctcatccactcgccttttgacagcaacctcgagaagggcaacgtcgatctcttcctcgagaagggcgtcactgtggtggaggcctcggcattcatgaccctcaccccgcaggtcgtgcgctaccgcgccgccggcctctcgcgcaacgccgacggttcggtcaacatccgcaaccgcatcatcggcaaggtctcgcgcaccgagctcgccgagatgttcatccgcccggccccggagcacctcctcgagaagctcatcgcctcgggcgagatcacccaggagcaggccgagctcgcgcgccgcgttcccgtcgccgacgatatcgctgtcgaggctgactcgggcggccacaccgacaaccgccccatccacgtcatcctcccgctcatcatcaacctccgcaaccgcctgcaccgcgagtgcggctaccccgcgcacctccgcgtccgcgttggcgccggaggtggcgtcggctgcccgcaggccgccgccgccgcgctcaccatgggcgccgccttcatcgtcaccggcactgtcaaccaggtcgccaagcagtccggcacctgcgacaacgtgcgcaagcagctctcgcaggccacctactcggatatctgcatggccccggccgccgacatgttcgaggagggcgtcaagctccaggtcctcaagaagggaaccatgttcccctcgcgcgccaacaagctctacgagctcttttgcaagtacgactccttcgactccatgcctcctgccgagctcgagcgcatcgagaagcgtatcttcaagcgcgcactccaggaggtctgggaggagaccaaggacttttacattaacggtctcaagaacccggagaagatccagcgcgccgagcacgaccccaagctcaagatgtcgctctgcttccgctggtaccttggtcttgccagccgctgggccaacatgggcgccccggaccgcgtcatggactaccaggtctggtgtggcccggccattggcgccttcaacgacttcatcaagggcacctacctcgaccccgctgtctccaacgagtacccctgtgtcgtccagatcaacctgcaaatcctccgtggtgcctgctacctgcgccgtctcaacgccctgcgcaacgacccgcgcattgacctcgagaccgaggatgctgcctttgtctacgagcccaccaacgcgctc

SEQ ID NO: 76 - DNA, 4200 bp, Schizochytrium sp.
tttctctctctcgagctgttgctgctgctgctgctgctgctgcttccttgctggttctcacgtccgttcgatcaagcgctcgctcgctcgaccgatcggtgcgtgcgtgcgtgcgtgagtcttgttgccaggcagccgcaggctgtctgtctgtttgtgtagttttaccctcggggttcggggtctgcctgcctcccgctcccgcccgccgccgcccgtatccaccccgctcgcctccgcccatcgggcctcgcctcctcgcgccgcacgcatcgcgcgcatcgcatgcatcatgctgccacgcacggggggacgcgcgccccgcgtcccccgccgccgccgtcgtcgtctggcgatgccgtcgccgccctccttccttccctcgcctcctcttcctcccgagcccccctgtcttccttcgcccccgcagcggcgcgcaggaagcgaggagagcggggaggagagaagaaaagaaaagaaaagaaaagaaaataacagcgccgtctcgcgcagacgcgcgcggccgcgtgcgaggcggcgtgatggggcttctcgtggcgcggctgcggcctggcccggcctcgcctttgaggtgcaggctttgggagagaagagtgggacgcggagaagataagatggtgccatggcgcaggacggagaggttgctgaaacttcttcgagcggcacaggcgatggcgagagaccgacagctgccggcgcggaggggatggatacctcccgaggctggcatggacgagctggccgcgcggatctggctggccgcgcggcggtgggtccggaggcgcgaggttggttttcttcatacctgataccatacggtattcattcttcctctccaggaaggaagcaagtcacatagagtatcactagcctaatgatggactctatgttttagggcacgtcggagcagaaggcgcgagcgattcgaatgcgagcgatagatacagcacagagaccttgccggcgacgcggatgcaggcgagcacgcacgcaccgcacgcacggcagcggtgcacgcgctcctcggcagatgcacggttctgcgccgcgcctttacattttttgattttaggtggtgtgcctgccactttgaacatcatccacaagtcaacgcagcatcaagaggcaagcaagtacatacatccattcgaattcaagttcaagagacgcagcaacagccgccgctccgctcaagctgcagctagctggctgacagggctcgctggctgtagtggaaaattccattcacttttctgcatccgcggccagcaggcccgtacgcacgttctctcgtttgtttgttcgttcgtgcgtgcgtgcgtgcgtcccagctgcctgtctaatctgccgcgcgatccaacgaccctcggtcgtcgccgcaagcgaaacccgacgccgacctggccaatgccgcaagaatgctaagcgcgcagcaatgctgagagtaatcttcagcccaccaagtcattatcgctgcccaagtctccatcgcagccacattcaggctttctctctctctccctccctctctttctgccgggagagaaggaaagacccgccgccgccgcctctgcgcctgtgacgggctgtccgttgtaagccctcttagacagttcctaggtgccgggcgccgccgcgcctccgtcgcaggcacacgtaggcggccacgggttccccccgcaccttccacaccttcttcccccgcagccggaccgcgcgccgtctgcttacgcacttcgcgcggccgccgcccgcgaacccgagcgcgtgctgtgggcgccgtcttccggccgcgtcggaggtcgtccccgcgccgcgctactccgggtcctgtgcggtacgtacttaatattaacagtgggacctcgcacaggacctgacggcagcacagacgtcgccgcctcgcatcgctggggacgcaggcgaggcatcccggcgcggccccgcaccggggaggctgcggggcggcctcttccggccggcggccgcatcaggcggatgacgcaagagccctcgcagtcgctcgctcgcgggagcgcagcgcggcgccagcgtggccaagctcccgccccttctggctggctgcatgcctgcctgcctgcctgcctgcgtgcgtgcgtgcgtgcgtgccttcgtgcgtgcctgccttcgtgcgtgcgtgcgtgagtgcggcggaagagggatcatgcgaggatcaatcacccgccgcacctcgacttttgaagaagccgcgatgcgatgcgatgcgatgcgatgcgacgcgataccgtgcgaggctacgaagcgagtctggccggccgtcatacaacgcacgttttcgagaaggagggctggcggaggcgtgcatgccggcgaccattgcgaacgcggcgtctcgtggctggcgaaggtgcctggaggatctaacgatcgctgctatgatgctatagctgtgctgatccccggtccattccaccacgtctgtgcctgccgcctgacctgcgcttggctttccttcaagttctcctccgccgggccttcaggaccgagacgagacctgcagctgcagctagactcgcgctcgctcgcggaggattcgccggccgccgggccggacgggactcgcgaggtcacacggccgccggcgatcgcgatggctgtgctgacgtactcgtgcgtggcagccgtacgtcagcgacgccgcctccgtattgtggattcgttagttggttgttggttgatttgttgattaatttttttgttcgtaggcttggttatagctaatagtttagtttatactggtgctcttcggtgctgatttagctcgacttgggtccacaccactgcccctctactgtgaatggatcaatggacgcacgacgggccgacgaaagtgcgcgagtgaggtaacctaagcaacggcggtcttcagaggggacgcacgccctccgtcgcagtcagtccagacaggcagaaaagcgtcttagggaccacgcacgcacgcacgcacgcacgcacgcccgcacgcacgctccctccctcgcgtgcctatttttttaggcttccttccgcacgggcctacctctcgctccctcgcctcgccgcaccaggcggcagcagcgatacctgccggtgccgcctccgtcacgcgctcagccgcagctcagcccagccgcgagctagggtttgttcgtcctgaattgtttgatttgatttgatttgatttgatccgatccgatccgatctgatctgatttgctttgctttgctttgtctccctcccggcgcggaccaagcgtccgtctgcgcgccgcagcttcccttcttctcccagccctccttctgctcccgcctctcgcgcaagcacgcagcttcgccgccgcatccggtcggtcggtcggtcgatcgacccgcctgccgctgctgctgtggccgggcttttctccatcggcgactctttcttctccatacgtcctactacgtacatacatactgccggcttcctcctcttccagcgcggcgacggcggcaggctgcgacgtcgtcgccgccgcgggcgccgcgcgcgccgccgccgccgcccgcgtcgcagggcctcgtcgccgccgccgctccgctccgctccgaggccgcgagagggccgcggcggcgcgatggatggatggatggatggatggatggatggattttgttgatcgatggcggcgcatgggcggagatgagcgaggacgagcgcgcgagcgcggcagccggattcgcagggcctcgctcgcctcgcgcccgctgccgcgcccgccttgcgagcctgcgccgcgagcgagcgagcgagcgagcggggctttctttgtctcgcgcgccgcttggcctcgtgtgtcttgtgcttgcgtagcgggcgccgcggtggaagatggctcattcaatcgacccattcacgcacgcactccggcgcgcagagaaggccgaggaggagcagcaagcaaaccaaaagctctcgcgctcgcggtctcgggctcgagcggtctcggagagagagtcttgcggcgaccaccggcagcagcagcagcagcagcagcgctgtcgagcacgagcacgagcacgagcacgagcacgagcattcgagcaagaggacagacacggttgtcagcgcctagctcgctcgatacagaaagaggcgggttgggcgtaaaaaaaaaggagcacg

SEQ ID NO: 77 - DNA, 3886 bp, Schizochytrium sp.
  misc_feature (2115)..(2115): n = a, c, g, or t
gatcttgattgccaagctctggattgtcgattccgatgaatcgagctctttgttgtcgagctctggcttgccgagctttcagaaatagacaaaattgccgagttcctgattgcggggctctcgattgccaaggtctggtggattctcgaactctcgattgtcaaaatcttggtcgtctcgtcggattctttcctgatttgttttgtcaagaccttgagattgtgcaaaaccttgatcgttgacaaacccttgatcgacagcagcctttcatcacgctcagctcttgtcattgattatattccccctgacagccaacaccttgatgcagggtctcaaccttgatttttggaggccatcatcagcatcacgccccggcactcaccctcaacattcgacagccaacgcttttttttcttcgactaggatctgagaataaaagcaggtcaccacgaccgtaggccaacgcgacaaccatggaaataaagtgacaacgaacgacttgcaagtttaaatgtaaagagcagcaattgcccgcccacagacaaatgaaagcaggcgccgagtcttatttgaggaggtgggcctgtggcaatgggcgaaagaaaatcaaggacaaggagagcaggttacgtaccggtatactggtatacgtacatggatggttcttggcaagttgacgggatgtgtgcgagtgaccgtggtagttaacgaaagagccgcaagggcaaggaaagcaagagaatgcagacttttccacaggatggatgggtccgcagcttgccgcatgatgaaacgctgtatttcacctggcacgtggtggcgcacgcgcccacatatgatcgcggcggcgggtgtattatacattttccccctcaggtctactgccatccctccatgcgtcgctcgtgcgaacgacgcaagcctttcgcatcgtgcagcctctttctggtaaggcaagagctaaacccaaacctaaacgaaagaacatttttacctctctctctctcccattggtcgcgtgcgctccgccgctcgctcctcctcctgccagtgtcgcgccctaacttcccccctccctccctccctccctccctccctctctcctgccaccgcccctctctccgcgctgcgtgcggtgctgccctggaccaatggcatgctgctgcacgctcggcggatgacgcaagccgcttcgcaatttccggatcagatctcggcggggcgtgcgccgcggggtcactgcggacctgccgcggcccctgcttctttcacatccatcatgtcctccaaacctccgcctcctccacgcacgtacgcacgcccgctcgcacgcgcgcactgccgctgcgaaagcaagcgcccgcccgccgcccggcgacgggaaggcggccgcggtctccctccgcggttgcctcgctcccgcgcggggctgggcgggcagcagaaggcgggtggcggcggcggcttccgtcttcgtcagcggcctacgtcggcggcggcgcgcgagactacgcatgcccttgcgtcatgcgctcgcaggtagccgccgcgggcctagcgtttccgctggcgccgcgcctaagcccccggcgcgcacggtattgccgcgataccgtacggccaagaccgccgcagacgtcggccctctcgcggccagccagccagcagcgcagcggaggaagagcgcgcaggcgcggcgggagggcggccgcggagcagcgcagagcggggcggagcagcgcggagcagaacgggcagactcggagcgggcagggcgggcagagctttggggtttaaggaccgggttaccggcgaagtgagcggctgcggggagcggctgtgggaggggtgagtacgcaagcacgatgcgagcgagagagagacgctgccgcgaatcaagaaggtaggcgcgctgcgaggcgcggcggcggagcggagcgagggagagggagagggagagagagggagggagacgtcgccgcggcggggcctggcctggcctggtttggcttggtcagcgcggccttgtccgagcgtgcagctggagttgggtggattcatttggattttcttttgtttttgtttttctctctttcccggaaagtgttggccggncggtgttctttgttttgatttcttcaaaagttttggtggttggttctctctcttggctctctgtcaggcggtccggtccacgccccggcctctcctctcctctcctctcctctcctctccgtgcgtatacgtacgtacgtttgtatacgtacatacatcccgcccgccgtgccggcgagggtttgctcagcctggagcaatgcgatgcgatgcgatgcgatgcgacgcgacgcgacgcgagtcactggttcgcgctgtggctgtggcttgcttgcttacttgctttcgagctctcccgctttcttctttccttctcacgccaccaccaacgaaagaagatcggccccggcacgccgctgagaagggctggcggcgatgacggcacgcgcgcccgctgccacgttggcgctcgctgctgctgctgctgctgctgctgctgctgctgctgctgctgctgctgcttctgcgcgcaggctttgccacgaggccggcgtgctggccgctgccgcttccagtccgcgtggagagatcgaatgagagataaactggatggattcatcgagggatgaatgaacgatggttggatgcctttttcctttttcaggtccacagcgggaagcaggagcgcgtgaatctgccgccatccgcatacgtctgcatcgcatcgcatcgcatgcacgcatcgctcgccgggagccacagacgggcgacagggcggccagccagccaggcagccagccaggcaggcaccagagggccagagagcgcgcctcacgcacgcgccgcagtgcgcgcatcgctcgcagtgcagaccttgattccccgcgcggatctccgcgagcccgaaacgaagagcgccgtacgggcccatcctagcgtcgcctcgcaccgcatcgcatcgcatcgcgttccctagagagtagtactcgacgaaggcaccatttccgcgctcctcttcggcgcgatcgaggcccccggcgccgcgacgatcgcggcggccgcggcgctggcggcggccctggcgctcgcgctggcggccgccgcgggcgtctggccctggcgcgcgcgggcgccgcaggaggagcggcagcggctgctcgccgccagagaagagcgcgccgggcccggggagggacggggaggagaaggagaaggcgcgcaaggcggccccgaaagagaagaccctggacttgaacgcgaagaagaagaagaaggagaagaagttgaagaagaagaagaagaaggagaggaagttgaagaagacgaggagcaggcgcgttccaaggcgcgttctcttccggaggcgcgttccagctgcggcggcggggcgggctgcggggcgggcgcgggcgcgggtgcgggcagaggggacgcgcgcgcggaggcggagggggccgagcgggagcccctgctgctgcggggcgcccgggccgcaggtgtggcgcgcgcgacgacggaggcgacgacgccagcggccgcgacgacaaggccggcggcgtcggcgggcggaaggccccgcgcggagcaggggcgggagcaggacaaggcgcaggagcaggagcagggccgggagcgggagcgggagcgggcggcggagcccgaggcagaacccaatcgagatccagagcgagcagaggccggccgcgagcccgagcccgcgccgcagatcactagtaccgctgcggaatcacagcagcagcagcagcagcagcagcagcagcagcagcagcagcagccacgagagggagataaagaaaaagcggcagagacg

SEQ ID NO: 78 - DNA, 20 bp, Artificial
  synthetic
catatggcgctccgtgtcaa

SEQ ID NO: 79 - DNA, 35 bp, Artificial
  synthetic
gccaggaagctttgacatggggtgccaggacatct

SEQ ID NO: 80 - DNA, 37 bp, artificial
  synthetic
tcctggcaccccatgtcaaagcttcctggcaacccta

SEQ ID NO: 81 - DNA, 20 bp, artificial
  synthetic
agtatacagaggtgctgaca

SEQ ID NO: 82 - DNA, 28 bp, artificial
  synthetic
gcaccccatgagcaagctccccggcaac

SEQ ID NO: 83 - DNA, 28 bp, Artificial
  synthetic
gtatacagaggcgcagacacgttgtaag

SEQ ID NO: 84 - DNA, 28 bp, Artificial
  synthetic
ctgcagccagatgctcaagatgtacatg

SEQ ID NO: 85 - DNA, 31 bp, artificial
  synthetic
ggagcttgctcatggggtgccaggacatctc

SEQ ID NO: 86 - DNA, 10 bp, artificial
  synthetic
ggatccatgg

SEQ ID NO: 87 - DNA, 31 bp, Artificial
  synthetic
aagcttgtgcagtcaagtgcgcaaaaccatg

SEQ ID NO: 88 - DNA, 15 bp, Artificial
  synthetic
taacccgggtctaga

SEQ ID NO: 89 - DNA, 31 bp, Artificial
  synthetic
gactgctagcttaagcaaggattttcttaac

SEQ ID NO: 90 - DNA, 31 bp, Artificial
  synthetic
gactggatcctcctgatgcggtattttctcc

SEQ ID NO: 91 - DNA, 12 bp, Artificial
  synthetic
ctaggcggccgc

SEQ ID NO: 92 - DNA, 31 bp, Artificial
  synthetic
gactactagtctaagaaaccattattatcat

SEQ ID NO: 93 - DNA, 31 bp, Artificial
  synthetic
gactggatccagctttaaataatcggtgtca

SEQ ID NO: 94 - DNA, 46 bp, Artificial
  synthetic
gactggatccgccaccatgttgcagcatacttggctaccaaaaccc

SEQ ID NO: 95 - DNA, 35 bp, Artificial
  synthetic
gacttctagatcaataatgccagaattttggctgc

What is claimed is:

1. A chimeric polyunsaturated fatty acid (PUFA) polyketide synthase (PKS) system comprising a replacement of a FabA-like β-hydroxyacyl-ACP dehydrase-2 (DH2) domain in a *Schizochytrium* PUFA PKS system with a DH2 domain from a *Thraustochytrium* PUFA PKS system, wherein the chimeric PUFA PKS system produces a ratio of omega-3 to omega-6 PUFAs that is different from the ratio of omega-3 to omega-6 PUFAs produced by the *Schizochytrium* PUFA PKS system.

2. The chimeric PUFA PKS system of claim 1 comprising a replacement of OrfC in the *Schizochytrium* PUFA PKS system with OrfC from *Thraustochytrium* 23B.

3. A chimeric PUFA PKS system comprising a replacement of OrfC in a *Schizochytrium* PUFA PKS system with OrfC from *Thraustochytrium* 23B that is encoded by a nucleic acid sequence optimized for *Schizochytrium* codon usage, wherein the chimeric PUFA PKS system produces a ratio of omega-3 to omega-6 PUFAs that is different from the ratio of omega-3 to omega-6 PUFAs produced by the *Schizochytrium* PUFA PKS system.

4. The chimeric PUFA PKS system of claim 3, wherein the nucleic acid sequence comprises SEQ ID NO:70.

5. The chimeric PUFA PKS system of claim 2, further comprising replacement of OrfA in the *Schizochytrium* PUFA PKS system with OrfA from *Thraustochytrium* 23B.

6. The chimeric PUFA PKS system of claim 3, further comprising replacement of OrfA in the *Schizochytrium* PUFA PKS system with OrfA from *Thraustochytrium* 23B, wherein the OrfA from *Thraustochytrium* 23B is encoded by a nucleic acid sequence optimized for *Schizochytrium* codon usage.

7. The chimeric PUFA PKS system of claim 6, wherein the nucleic acid sequence comprises SEQ ID NO:71.

8. The chimeric PUFA PKS system of claim 2, further comprising a replacement of OrfB in the *Schizochytrium* PUFA PKS system with OrfB from *Thraustochytrium* 23B.

9. The chimeric PUFA PKS system of claim 3, further comprising a replacement of OrfB in the *Schizochytrium* PUFA PKS system with OrfB from *Thraustochytrium* 23B, wherein the OrfB from *Thraustochytrium* 23B is encoded by a nucleic acid sequence optimized for *Schizochytrium* codon usage.

10. The chimeric PUFA PKS system of claim 9, wherein the nucleic acid sequence comprises SEQ ID NO:72.

11. The chimeric PUFA PKS system of claim 1, wherein the DH2 domain from the *Thraustochytrium* PUFA PKS system is from *Thraustochytrium* 23B.

12. The chimeric PUFA PKS system of claim 11, wherein the nucleic acid sequence encoding the DH2 domain from *Thraustochytrium* 23B comprises SEQ ID NO:73.

13. A chimeric polyunsaturated fatty acid (PUFA) polyketide synthase (PKS) system comprising a replacement of the DH2 domain in a *Schizochytrium* PUFA PKS system with a FabA-like β-hydroxyacyl-ACP dehydrase-2 (DH2) domain from *Thraustochytrium* 23B that is encoded by a nucleic acid sequence optimized for *Schizochytrium* codon usage, wherein the chimeric PUFA PKS system produces a ratio of omega-3 to omega-6 PUFAs that is different from the ratio of omega-3 to omega-6 PUFAs produced by the *Schizochytrium* PUFA PKS system.

14. The chimeric PUFA PKS system of claim 13, wherein the nucleic acid sequence encoding the DH2 domain from *Thraustochytrium* 23B comprises SEQ ID NO:75.

15. A chimeric polyunsaturated fatty acid (PUFA) polyketide synthase (PKS) system comprising a replacement of a FabA-like β-hydroxyacyl-ACP dehydrase-2 (DH2) domain in a first PUFA PKS system with a DH2 domain from a second PUFA PKS system having a different amino acid sequence from the DH2 domain of the first PUFA PKS system, wherein the DH2 domain from the second PUFA PKS system is at least 95% identical to SEQ ID NO:74, wherein the chimeric PUFA PKS system produces a ratio of omega-3 to omega-6 PUFAs that is different from the ratio of omega-3 to omega-6 PUFAs produced by the first PUFA PKS system.

16. The chimeric PUFA PKS system of claim 15, wherein the chimeric PUFA PKS system comprises SEQ ID NO:2, SEQ ID NO:4 and SEQ ID NO:74.

17. The chimeric PUFA PKS system of claim 15, wherein the chimeric PUFA PKS system is encoded by nucleic acid molecules comprising: SEQ ID NO:1, SEQ ID NO:3 and SEQ ID NO:75.

18. A method of altering the omega-3 to omega-6 ratio of PUFAs produced by a first PUFA PKS system, comprising expressing the chimeric PUFA PKS system of claim 1 in an organism.

19. A method of increasing the production of PUFAs and of altering the omega-3 to omega-6 ratio of PUFAs produced by a *Schizochytrium*, comprising expressing a chimeric PUFA PKS system in an *Schizochytrium*, wherein a DH2 domain in the *Schizochytrium* is replaced with a DH2 domain from a *Thraustochytrium* PUFA PKS system, wherein the chimeric PUFA PKS system produces a different ratio of omega-3 to omega-6 PUFAs as compared to the *Schizochytrium* PUFA PKS system, and wherein the DH2 domain from the *Thraustochytrium* PUFA PKS system is optimized for the codon usage of *Schizochytrium*.

* * * * *